United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 36

SEQ ID NO: 469 - DNA, 212781 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctg

SEQ ID NO: 470 - DNA, 180410 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaa

SEQ ID NO: 471 - DNA, 195044 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaa

SEQ ID NO: 472 - DNA, 216832 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgcgtctggcagtcttcacgggtggttttcaaagcagatactgccttcaagatggccctttattccagaatgttttggctttcctttggggagattgggttgggttgggggagttatagcaaaggtaaaatgaagaatggaggaaagtaaacaaagagatattaaatagtaatattgaattcatagattctctttctccattttcacctgagctggaagatgaccagtatttctagcccatcagtaagctgttacctgttcctatttgtttgcaagtctgctgggttttactttattttattgtcatctcaggctaatctttgaccatttactaaaaggtttacataatgtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattgtcatcttagtctaatccttgaccatttactaaaaggtttacataatgtcaaattcatacttgtgtggtagttccatgggtagggatgactttcatagactcttcccactcatggactggggagtacttacaataaaaaatgacaggctgggcacggtggctcacgcctctaatcccagcactttgggaggctgaggtgggtagatcacgaggtcaggagatcaagaccatcctggccaacatggtgaaaccccatctctactaaaaatacaaaaattagctgggtatggtggtgctgccctgtagtcccagctactagggaggctgaggcaggagaattgcttgaacccaggaggtggaggctgcagtgagctgagatggtgccactgtactccagcctaggcaacagagcaagactccgcctcaaaaaaaaaaaaaaaaaaaaaacattctggacttgcaagcctgttggttacttcttcaagggcctttccccaaaaatgatattttagaacgttatggaatttatgaaatcagaggtttccctgcaaccaatctatgaaaaagtaggcagggtttaaactgttttaaaactttagtcttaaattcatatttttttaatgtattaaggaagtctatccattctgtttcaatcgttttttgaaacatgaaaaggaagttagagatgaaatcattcttcatcactacaagtgatatttatccttaaatgttgacatttccccactgtgctgggcttctagatgatatctaggactacgaaatattcctgaacctagagattatggagagaaaagatgaatcacttttatatgttggttgaatttaaattagcatttctcagagagcttaatttaagtacccccaaagccaaaagtttgaaggctcaaggcccacatatttcaatttctcaggcacgttcccagtttagaggcagctagctctcacgtctgtatcactgtgactccgggagaagcagggaggttcatacgttttccgttcctgttagcaagagttcagatgatggcattccatgtcatttcaggtcacgtcaaattagactctgtgaatgccagtgtgaagaaaagagtcatttagtgttgtgcgttggtaacattttttatcaaaagctgagaaatgtgactctgaataagccacgtcttcctcagtgccaaaagtcaggacttcttatactgggggaagaaagcatggtgtggtgaaaacagtgtgctcggtggcctaatggcaagagtcactgagcattatcagacataacatgatagaaggtaacagggtacagccaacccttgaggcatcatgaaagagattgaccaaagactgatatagctgtgggttttggaagagagatagaccaaagattggacataacctccattgtggtaactgtgaagccaaattaggttctctcaggcttacctttgactgtgtttgttggacactgggatggatagttccaaattgaatgttaactagttgcatttcatggaaaaaatgaaaagcacacaaatgtatgacactgttgtcaggaataaatctaagttactatgctctttttttttcataagacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttctttcccttccgaatccctgagccttggtccttatataagctgagaggtttccaggacctaatgccttcttgtcttggctcatatgccattatttataattgtgatgagattgaaaatcccaaaagctttgatgagctaggcaatttagctgatctttgcatgcactcctgtgaggaaactcttggctacctaattttcgattccaagggtgtggaatttcctagcctaaataattaagcagcctacaatgaatagaaattctctgttctctgatgatataataccgtgaactctgtccccttaccttccctgctatgtgcctcttattgcaccacacttatgcagggtattctgtgctcacacaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaact

SEQ ID NO: 473 - DNA, 216832 bp, Homo sapiens; identical to SEQ ID NO: 472

SEQ ID NO: 474 - DNA, 180410 bp, Homo sapiens; identical to SEQ ID NO: 470

SEQ ID NO: 475 - DNA, 216832 bp, Homo sapiens; identical to SEQ ID NO: 472

SEQ ID NO: 476 - DNA, 180410 bp, Homo sapiens; identical to SEQ ID NO: 470

SEQ ID NO: 477 - DNA, 216832 bp, Homo sapiens; identical to SEQ ID NO: 472

SEQ ID NO: 478 - DNA, 195044 bp, Homo sapiens; identical to SEQ ID NO: 471

SEQ ID NO: 479 - DNA, 216832 bp, Homo sapiens; identical to SEQ ID NO: 472

SEQ ID NO: 480 - DNA, 1111867 bp, Homo sapiens
ggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcgtaagtaaacactgtgtctcaactatgatttactactgagtttcccttctgccctcctgctgtctttttccctcgccgcctgttttctagcaagccccctcccccatcccaggtttggggcagagtgagagctgattaaaactggccaccagcggggaagaaggtgccagcctgctctggttctgggggggtgggggcgtgtaggaacgggagggagattgtcaggctccactggccccactttagcgggtcccaagtgagaacagatctcccaactcccttcaaagggttaacgcgagtgcgatccctcctcactgcagacctgctggcgagctgccggatcccgctccagtagagggccagggagggagagagggccttcccgaaggcactgagccccttctccgcccgccggtaggaaggaaagaaagcaaagcacatgcaaattgaccgacgataaaccacaaaaggaagttatgtccttgtgtggggtgacgagttgatggagataatggtagaatgttgctgaggacgcttccagcagccctgacctgggcaggaaccagaaagggttaattagaagccactgggagacttggggaaaggaggcgatccaaggcaaagggctaaactgacctcctagcctgcctgtggccattccaaggtgtagacatagattctgtgaccgccgagagtgagttaactaggaggaaatatgaagggagccctgcagagctgccacctctagggtcctgacgaaggaggagtttttttcagccctgccaagcctttgcttttgttccgttcccaaaggtggggtgtgaaccttatctcctctccctctgtgcctgaaaaatatagacgagttgagagttttctgcactcaagggtgagaacatccaaccgtttggaaacatgtcaccgttagaatgtagcatcttcaacctgggctcagtatgagccagtatacccaaagcatgatagctttctgtttatttgtatagaaagtgcgtattttctcaacatttttataaatgttgtaggtgactaattgacctcccaccccaacccccaccttgttcttattcaaaggaaatctcaggtgtcttttaagctgatctgatcaggatatgggaacagtttgtgcaacctgtgaaggttatttaggacaaaccccaggctgctagttcaagttctgtgcaaggctattttgcaaaaaactgtctggttatgctgtctttatattgtatttgtgttttgagccatagcatctgagataaaggaagagtgttcatcattaactcttcagtgatgatgggaatactgggtttgctttcagtcatctgctaatttttcatttccctgccctatgatcttaccctgggtgttacttaacccttgaaacttttttctttttaaagaatgtagtgtatttgtaagtaaggtccaggagagggaaagggggaaaaaaaagcaaacctactttgctttggaaaaaaccgtctagaagataaattgggagacaggaaggagggaaggaaggaatctgccacaaaccagaatggcagtagagccagtaacttgctgcttctctctcctttggctgaagcagtcatttttgagagcacattttcccaggaggtgtttagagcctccactcaacaaatctagcttgtgttttgtagaaggataaaggattcatgagtgtatgtgtgaacatattcaatggattgaaaatgagtctaccctgaagaccccagatttttgatctgctcttttgatgcagttgatagaataatggagtgtggtatacctccaacccttgtatgcgttgggagaggagggggactacacacggtaggggtatttcatgttctttctcaattgatttccttgtgtaccattccggaggtctttaaagaaaagcccaaggtaattatttctacccctctatgctctcttcctacattccgtggacgggaatggcagcctgtttaataagtaatgattattgacagggccctcagccccaaggaaaagaggggaaaaatctgtaaatggtgtcaatgttcacatagacatataagcagtatttgttgtatttgtatcttagtttcagctctttctcttttttaaacctttacaagaagttgaattaaggtatgtaatacaagtatgcaaaatccagctgaaattgacctggtttgcatctataaacaagggaaattttaaggaaaagtggattatgtagttttcataaaacgtgtttaaataggcaagttgtatggtgacttgaagaaagaggatagtttagttatttttttcatccaagattgcaggatgattaacaaaaggaaattaagatttcatttgagagattatcagcagtgctactgtaggatgaaaaaagcctgaatcactggtgttcatattttttttacttgtcttgattatgcccgtaaagttcccaggagagaaattttcttttccccagctcctacctccatactttagtgggtctttccgtcctttcttttttttaaatgaaagtaatggattctgttgtagtacttgaaaaaaggttaaggatgatgctttcgttttttgactaacccacaaattctttaatggccaggatctttgctcttgcattggatacctgaaggcttatggaatgaatgtctttgtgttcatcttagatcaatcagaaggatcctgtctgtaaggatcctgtctctttggagtggaagaggctggttcactgacaatgaacatgcttgctaatggataataggattttttcaagcaaaagctgtttttgctatgggaaaggcccagttagagaactgtttctaattttctgtaggaataaagacaaagaaggattgaactttaaaggcaggaggagaaaggagggtttgcaagttgattcttctcttcccgtcctccaccgtttaggccgtgagctggaccaaaactttcttcagcgttcctgggattcttgggtttccacttgcctagtacttgcttgcacttcagactctaaaaacgaatgtcttaaacatatcgccaggggagattatttcaccagaaacatctttgaagcattttgtatttgaaagtagaggttaatttacaagtttttcaagccaaagggaggaggtcactacagacagtagaaaacagtgattttgaccaatgtacaatcagcctttcccttttacagcgccttcaatttcgttttcagatttgaaatatagttgtacaatgctgccaatgcaaatgtggattgttttagagacatagaattcttttactaagctgaaaatactgtttaacaggtggtagcccggagtcattggctaaattcaaatactaaagacaaagagcctctttttataggtgtttctttgggttagatttggaaggtatatggttaattataatgaacatcacaaatatctaatagtgtatttaagaagaaataaatgtagaatgtacatttgatgtttaagcaaggtatggaggcaattttaatttaatcatgtctatttctataaaactttacctagtcatacctactgtaatttttaagagaggcattgataaaatcaagtattttcttatttattcttttcaacatcttcattccttaaataagggtacacttgtttgctttataagcagcctcagatataatttgtttaaataaagttacttctgtacattgtattctctctacatgagtcgaggcctttaaaggcatccaacgtagaaggtactgaccccaatcatgcatggtagccaaagtgagaggattcagagctcaggatcaatatttcttatgaaatccaattgagagcttttttttatgagcacaggctgcaacctgagtatgttttgatttcctttggccttaattcaggattatgagacttttctgctttaatcaattatgctgtacaattttactgttacacacttatgttgcacttcatggtcctaattaaaaaaagagggcaggggtgggtgtgttggcaaggatatttttagggccctttttagtttggactcgttggtctccgtgcattaagacaatgcggtttaagcattcctccccagttcttcagactgaagtgagggataggaggtgttgttaattgagagtcccttctgcaggattaatttgtgaatccagctacagttatatttgtgctattttcaaaacctgaccaaaaaaaacaaaaaaaaacccagctggtttctggcaatttctcgctgttactgaagcttttctaaattcaggttgggcaacaacaggagtgttggtgcagtttgaaatcagtgccttcctgggagatccaggatgtagaggaataccatctctcctctctctggagctactttctcagcccttcctcccctttgtacacaatgagaagaaagcttattttcaacttgcttttgtagaaattctttcctcataacctctcatctccaatgccaaacatatctcaatattctatctgggatgtcaaaaatggaacatgaaagttggccctgaagtatataagagcaagggaatagtcataaatctaagtctgtaaaatgcatttgaattgcttctgaatagaactgaaattcatttttctttctttctagctgtttttatctttagactcgtgtgttgggtaaggacagagctggtactgcgttgacaaatacattttgagatcctagaaattttacttatccacccaagaaagtgttccctccagaaccatatacataatgaagtgagcaatggactctatttgaaactttgcaatatcacaatcaaaacttacctacataaatgtttcctcttcatgcaattataaataaaatcattagacacatgtttagtttggttttccatttcactcttcccctaagacttcctgtactcccacctgccagtattttatagttgaatcatggctctgactgaaggctcctttcaggcttttgtgttttttttgtgttttttttttttgtttttttgcccttttttccttagcctagagtacaaggagtcaatactcattaaatgaaatttcttagatatgcttaacgtcttgcttcaagttgttttataagttaatcttttgggtaagttagagtgcttaagttgatgtagaaagttaaggaaaaaaatactcctttagggaactgagttattaaactgtcttggtgatttaaaacaataattaaggattcttaaaacctgatggaagctaatggtcatttcttttcccccatagattggtatacaaatcatattaattttggtagcatttttatctgattccacaacacagttgagcaattgaacataagctatcatatacattcatataattatattttcataatatatgtcacatgtttcaaatgtttactaagtatctatctgggggcattgcaatgctgttaagtaattggttgactccgaaagtttgtaaaagtaatggttcataaagcagacaattaaaataaaacttttaatcactacaacattcagcctcccatgtcttgatgttagggcgaaggctttttctaagtatgtgtctactggtttaagcttagcatctttgcttttcttttttttttaattagccacacctgtaactatcagctttttttttcttttaaaagacactagcgaaggaatccgtatgcagattctttataaatacaataataaacccttgccctgggaatctcttgcagttttcttgtctatatgattcagtttctttttttatgctttaaaaaacaacttaccttttggagtttcttcaaagcattcaactacattttaatagaaactacaattatctttcatttccataatcatatatcactggtttacataatatttaagtaaattacataattagcataagaacaactgacgtaaacaaatctattatcccaactgagtactgtaaagtgcacaactcagctggcagttgcagcagagtgtaggtttccttgagcttggcctggtggctgtgtccctttcactgtgcagtgggcctctttggtgtgttcctgccaggcagtgtggtggcagccagttggctaagaggagttagattaaggaagtgattcctttaggaggtaacagtattagaaatgagagtcagtcataaccatattttttagggactctcatggaagggtaacaaatatatgtgtgtgtgtgtgtctgtgtatgatacatatatatatttataaacaatatttgtttgtatatttctatataaaacctctagccgtgaattctataatagctgtgcaacctttaggaactgatacaatctctctgaagtttaacttcctcccctggtataatgaggttgatgacaataacctgacttctatgccaatcccgaaagagtttataagctgaaaaacaatcactgtttttatgtcaagtgaaatgggaagtagatagactggttattttcatccaagagcacatcagactattgaattcggttgaaatattggagctggtttgttacctagcttgagggatctttcatcacaatgaaagattattgttcttatatgcccttgggtttttcttatattcctctctgatatcctggcacacacaataaaatatagtgtggagtcctacctcaaatcaccttggaagttgaaccacaaactggaggtcatcatttctcattctttgcttggaaggtgttttttaaagcctatttccagcatatgtttatcaaagagaggagctgaaatttgggagaaaatgagtgagattcctgaatgatctggaaatctgaaatctaaacattcttgataaagcaaaatatgtcctaggtgcccttttgtgccatccctacactaattgtcattgggtctttagattttggagagaatttgtgtgaaaataggcatgtctgcactgcattcccttggccacttagcagttactgtgaattagattctcaagaattaataggttgattgtatccatcaaggagctcttttaaagatactgtttggatttgtactttggggaactttaatattagcattttggaaatatatttcttcaaatctgtgtttgttggaaatctcatcctgaattatatcttaaagtattactttttgttgttataagcttttatttctcaagacaggttggtgattgtacataaatcatagattgccattcctgggcctaaaaagggatcagtcagaagcaaacctacaaactgaattcagaattaagtttaataatggaagtttagcagcttccagtgctaagattttgtctttgaggccttttcctggaagtgatagtgtgtatcatggatgcaatataggccatacgaacatttttttaaagaaaaggtcagctgaatccatgcaactactttagcattagtatgttacagccagggttatgggaatagaatttttatgctaaacgtttgataagaattcttaaatatatcagccttcctcctcagataccttcctatgactacatgcaacctctggcatgatttcctgtgaattgccagggagctagaaatccactaaaagagaaagccacaccctcatcatcatcagattttcttcatttttgtagcttgaattttacttttagtaatgtagaaggattagtcacagataatcagtcttggaaggggcttaagaatttaagtaataataaaaacgacagctgccatatgtggagggttaccgtgtgcctgggcatgtagcactgtacattcttcgtgttatttatttttgaaataaggattgaaaaacaatcatatctaggcctgcagcctaggtttgattatctcactgatagagttaatcaagctgggcttaggatatataatttgcctaggacttgcagaaattgtttggataatcaagaagactggaggagtgttttacaggtaatctctccccacctcagtcttacttacctaattcactgttatagtgtcactatatccatttgtacattgcttctgtcaagcacttcacacacagatagtggcatttgccactgtaaactccataaatagctcacctgcactgtacctgttctttgctctgatatggaggaatctaactagagaaattgcctgggttttctgtctaaggagaaattcagatgtttcggtaaaagataaagaatatgttgttctgaatgttgtcttcttgtttattttttaagttttgttgatatgtaattgatatgcaatgtgctctccatacacatccttgggttctgcatctgtggatttaagcaaccagggatcaaaaatatatttaaaaataaaaacaacaacacaacaattaaaaatacaaataagaaacaagtatagtataacaactatttacatagcatttacactgcttgtaagttctctagtgatgactgaaactatatgggaggctatccttaggttatatgcaaataccaggccattttatgtaaaagacatgggcatcctaggattttgatatcctgggggagaggaatcctggaactattcccccctggaataccaaaggatgactgtacaaaaaattgtacatatttaatgtgtacatatcgatgagtttggacatgcatatacctattaatgctgtcaccacagtcagggtactaaacatatccatcacctccaaaaatttccttgtgttctcttgtggttttaattttgtttaggtagaacatttaacatgaaatctatcttcttttttaagtatgcagtattatattgttaactaagtactatgttgtacaacggatctctagaacttattcctcttgcataactaaatctttgtacccattgagcaacagttccctacctctaaacttctgttccttgatctttttaactctctattttctcttatggctgcttgtaggtgattcaatgtaacaatgacagaaaacagttacagactttattcctctgcttcctaaaatccagtcaaaattgccttctctgcccattccaagcttacttttggttacaatagtgactgcagtgtatgctgagactgatcaatggaaaagtgtcagggaacatttggaatgatagccttttagttctgtagacactaaagtactgactctaccaaatcaatgatgggagttggagctgcatgcaatgcctgctgcagaacatctgaattccatcttggagccacactgcgaagtacccatcactgattatctaccagttctaagaaggggaacattggtgagaccttgatattctgccgggggtactacaaactagacccaatcattgcttacttgcttgacatttttgtttgccaagtgttcttttagctagaagaaaaaaattctcttttggttaaagtaaaagatagttgagattgttacttttacaaacttataaaaataaaatggaaatagatcaagttctaagatcacgtgacactcatttgaatagccatgctgaaggataggaatactgtagtgtcagaaagattgtattgtcaacatcctgtaagactgtaaatgaatcccataaactaacaatgacagttgtgctcattgttagtctatgaggggggccactggggttgtttgcccaaatttattgttagaccaaagcttttttcagcatggtggaaaaatctagagacaccagaattttttaaaaaatgggctgtagaaatgtttatattaaatgatagcttgactgaattctatttcattgacttttcagtatgatactctctgtttctggattaaaaaactaacacatttcgggtgtgggggaggtagagcatcaggataaatagctaatgcacgcggggcttaatacataggtgatgggttgataggtgcagcaaaccaccatggcacacgtttacctatgtaacaaatctgtacgtcctgcacatgtatcccagaacttaaataaaattaaaaaacaaaaacaaaaacttctgacaaatgcccactccatgccgagcaggtacagttggtagcacttctgtcttaaccaaatgaaagctgccttggttaacaggtattagttatattagctcccaaacctgtttatgctgattgtttttgttactgtaattgggtaatgcatttaagtattctataaatctgtgaattgtggtttctattaaaacgaagttcattacattggatataatccataaacataagtcactttaaaaaaagtgcttcttctacttgacaaagttgtgagaagtttaacgagaatatatttatatatccataagaaatttgcacttgtattgtttcacatgttaagattttattccacaataaactaaactggaaaaatcacattatacattatgggtatggtttttcataagaaggacaacagatgtttactcagagaaaagccttgagctctataaccaaatatttggcaagtgaatgtgcatttgtatgttttaagttaaaataataagtaaaataaattttgtttacccatgtgatagatattacaaagctattaaattttgttgtactaattttaaagctttcgggaaatgtttggtatataatttttatctaaaactttgggtagaaaattatataagatatccatgatattaagctttactggtcactagatttaatatatagtaactgtattcaaaggaagtataccaaattgttcatggtagttctttctggattttggaatagggatgctgtttaatttattgtacttttttgtattatctaagttttagttattgttcatgaattatctttttttctaattagaagttgttatacttttgaaaaatgtaaagaatatactccatgaatcagttcaattattggtcttggttctgtgaagattgttttttctttatgtctaaagagtttgtttcttaattggtggtgtcagcattaaaatgttgatggagttgggttgctgctgtgaaatgcagatgtgtagaagtgcaaatgcatttccatttgctcatgggaaataatgccttattgaaggcagagtttcttactctgggcctttgatgattagccttgactttataagggtatagaagatgggagtttaatgagatacttaatggctcttccagtctgcagatgttagacagtcttagtagtattgctatacaaggatatagccaacagaaatcaataagttatatacacatattaatcaactatctgatctattccaaggatcaaatgaaaagagaacacaaaggctaattgacagtgctgagtactagaaaggagatgtttggtcaaacatgaatgggtgggataaccagttcaaaggtttactggatgctataagcctctcccagaatcataagatatttattcttatattaattttcagtggctggaacatagacagactccagagtccataggagagtggtgatttgtagggcacatgacccataagtttggtgatgagttgtgctcaaagtccttcaaatagttcacaaatgcaatgttggtccaaaagagccagaacaaatatatgattctatttatatactgtgtaacaattagaagtcaagatggtgattatctttggggaggaggggcaggtagtgaatggaaggggacccaggtgtaggttttcctgtattgataatattgtgctgcttgatatgggtgctggttacatgagtgagttcacttcatcaaaatttagtaacttctatacttttgatttgtgcactttttgtatacatcaatactaacttgaaaaaataagagaaaacttcaggaacattcctttggcctttaccacttcatgcaaccagggtggtggcctgagtttataggtttttccatgtacagagactggatggtagctctgaaagtttgttgttggtgtctcacagtccagcagatgcaaagagggtcttcctggcttcagcattttcctttgttctcaggatcccctcttagtgagacttcatgcaaacacccacattcccttttgacgtaagcctttctgagtggacaccttgtatttatattcaataaaaccctatttcactcatatcaggagtgttcctgatataacacattgcgacacttttcacatatcttaacacatgtaaaaccccacttgtatcctgagaatggcattattacagttctgcaaacattaaagtgtgatatacacaagaaagataattcatcatctgcatctgtggtttttgttgagaagatcagaagatatgcaccaaagaatcattaagtgctgaaatgtgtgattccaaatgaaaagcatatgaggccatttcagaaagtagtgcttagagggagaaaggtagtttcaagggagaatttccttaggcagagtaatagagaagggaggcccagggagggaaaggtcattaataaaggtagaagtttgcatgtacccacctatatgggagccagtgagggttctgacctggtagacagacggcctcaccttttccttggagcagcgcctgattaaggagggagggttttggaggacacagcttgattctatgttaagccacagtcagaatgggttgcaaggaagtgatacaatatctgtggtattttcagaaggtgcgaggtttccaggatgacttggagagaggaatgagcagcgaattttaaagattctctaaggctaacttgttccaaatcatttaaagatattgtctctgatttgtgctggatatatttaagtattgacttcattccaatgcctcttcaaagcgctgcaagaagcaatagaattggcatgttttaaggatgtttagtttatccatagtcgcatcaacaaagccctagatttaacccaaaataacagctttcaaatacctaaaaatttgcaagtagagatacaagaagaataacaagaaggaactcttgatttcactgcctcacctaaattaacctcttactgtctttaggtttttcagaggcaaaaactcctttatgaattgattgccacatcacccttctggttccatctgaggtcttctttgcagaagccactcagcaccttttggaattgaatgctgacatcgcatcagattcaaaaggaatgctgctgttgattcctttctgtactcatcacatggtgaggaatatgctgggagtctgtataagatgaggctcttgcacggcctgccagagagtgcctgtcatggactggagaactgcatccgttcatttacatatcggcagctaaaattagtggagtcacccacgtttttcaccctaaagaagaaccttcagataagaatccagttcatcactctcgcctgctcaggcttacttggttgctccttgttaccagacagaggggctatagcgctgtgtaagagcaaatgttaaattagtattaatagccaatggcatctctcttctatttttcactgatcaggtaattttcactgatgtcaacatttataatacatcagctgacatatacaagtgttatttgcttggaatatttttagtttatctattttattgacttagataaagatatattttttaaagttatttgttcaggtctttttgtatttgatcagaagaggtttttgaaaggaaggcgaagctgtagatcagggttttaacaaaatgagcatcaaatccaaatctgtgtttctccttcatcactgagttttgtaagcttctaaatgaccttttgtggtaccacactgatgctcatcttgcattgtgagaggctctgagtaatttatgataaataatgaaatgctgtttcctccaatacactgcaaatggctgagtcttgtaaaagtctaaggagctctattacttctaaatgactagataacacaaaaatgttaaccctaaagagaaaaggtcaagtagaccacgtgcttgtgagccacagtccttctgcctggtgccttctgacaggctttctgcatctgaactctgcagggactggcacctgaaacattactttctagaatggcaaggaagggtttaagcctttcggctacttggattggctagaagcaatagtggtttgtttggagtggggaagggagaaacttgccgaatccatttaacatttgaaaccctaaattaatttttaaaaaaaatctgttaccagtggtaagaattttgtgatgctaggaaacaacaatttaagtattttatttgagcactgatataaaaagaaatattaaaaagcaagcagagtaatgttaatctgtaggaaactatagaaagctgacatcttttcaaaattaacctttgccatgatgtttgcactctcttgctcatatccacgtatacaaaaataaatacatagtgaacatattcagtctacaactctcagctccctggtattccacagtgtattcctaccattggaaaatactgtccacagtgaatatgtgtgttctcatcctgattgctgtaaaataactgcatatctaagtgttagggtttgaagactttaattgctagctacagagtgtctttatgtattgcacttccattttgaaaattgaattaaattgccggtcagtgaactctttataatgacaggagagtgtctatgcaagcaagccattgagcagagtgatctttggccagtgatacttttaaactcagacactttgctgaagtttgccactgaattttctcacatttccccagatgttattacattgccaaatgaaatcatctgttccccctagtagaactgcctcctttcctccagatatcagctacaaggtatgaaatgaattgcataaaaataaatcacacatgctgcattttgggaagagtactcttgctgatccattaatttcttttcactgctgagttgggaagtccactttaatcttcaattatcagtaacgtgcaattggatgaacctcttgacctttccaaaatagagatgctttcatgccaggaaatttgagctctttgaacatttgagaatatttttgcttttgatgaaaaaggtttgttgtcatgtgccgtgggagaaagagattgaaagaaggaaggttattcccaaaggcctgtttgatgattggactatatggctctattcctgaccatgtactctctgtaaggtttggcatggacagcaatgtgctgttggcaatatggcgcactttaaggtatttaagcatggactcaggagtttgtagattatccaggcttgttacctcatctccatatgcctagtctaccacttccacttagatgctctgccatgttgcaaactgaacagaagaccctgatgaacacaaggaagatgagggaggtgatttccatggagactgtggagaggctggagggtcttgtcttagggaagtttatcattcctttgcgcaatcttggtatttgtgacgtttcttttcttctttgcttctgtggaaagttggaaataagataattgggatagtggtttttgaaagggggaaaagtaattaagacacagtgggatgcccctgcctagtttgggaatgcaggctcagctctgctcctcaattgtttgagaccccagggtaaactacttgatctctagaatttcaggctcttctgtaaatgaggctgttggacaagatgtggcaaagattccaggaggccagggttttaaatttgagattagaatcttagtggaattttttgaattatggtttctctggctcgctctctccctacctcccttcctctgtctcgctctgtccacacacatataaacacacacagatgaagattttgtttttgtttggttagtgtattttatgttggacatttgtcagtttggcatttaataatatccatgtttcaatgtgatacatacgtgggacttggttaagtcctaaagtcagatgaactttgcttgtttacaactttaaaaaagaattccatccccttcttctgggagatgtagagcttggtagccagctataggtgtgctattgccaagtgtgtgtgtctctttgtgtgtgtatgtctgtgcattatacacacactttatgtaaatatatacatatatgtaggggtatatatatatacatattccaaaaatatatatatacatattccaaaaataagggtatgaggagccctggaggaattgcgggcacacacaaaatattttatttgaaagtataaataaattcatccaattctagatatgatatctcacccccttaagtaaatggaactcttacttgctgaattttacaaagagtgttacaagaagaacagagggctaaaaaatggtattcctagggccctattgtaaatatacctcaacgaaaggcaatatttcctgttacgttggttggcaaggggattttgatatcagaatgtggctccatctttcacattagaacatagctgtacgtggagatagagagtagatgaatggttgccagagactgagaagggtagtgaggggttacaggagaggtagggatggttgatgggtacacaaaaatagaaagaacgagtaagagctagtatttactagcataacagggtgactgtagtcaaaaataagttaatcgtacatttaaaaataactaaaagaatataattgggttgttggtaacacaaaggataaatgcttgaggtgatggatactccatttaccctgctgtgattatgactcattccatgactgtatcaaattatctcatgtaatccataaatatatgcacctactctgtagcaacaaaaattaaaaattaaaagaacacagctctgagctgcgacagtcagtgacatttaattcaaactcaaagtggctagtttatcatttttttccacttgcttttcttattattaaacagaggattttcactataggaaattagaaaatataagtaataaacggaaagtaaaagtcaagtgtagttctaccacccagagataattactcttctctttctgttcaatattagtccagtttttttgctttaggaatatgtatttgcaaaatgaagttgtactctaacacaattttagctaggtttttgcacttcatgttacaatatttttctgtcaaaacacctataaccctatatttaatggttctgtgatgatgtatatttacatattaaaacataatgagtgtatctcttcttgagaatttattttgcttcgagttcgtcattattatataaaattatgccctgaacatccgcagtatggaatggactttttttttgctaatacatatgcaaaaaagcttacttttttaaatgtgaaatttctaaattcacatccaggatgactgagcagttcatatacttgttgattagtgtcaaaatgctgatcctcccgtaaatcccctgatcgtcgtaggtgtttgcatttcattagcagcaaaacaaattaacaaaatttttgctagccatatagttttaaaagagtatcttcttggtttttatcttgcatttctctaattagaaatgagaaatcattagttagtaaatatcattagttaactactactgtggaaggcagagttcatggtggaggctagtgagcctgttctgtcttcatgggctgtgtgtcagatgcctctctgagggcttcaccgcaggcagtgatgtggtaaggcagagccaaggccttagaagttctaaaacttcccagtataatttagtaacaaaagatttttttcctgaaactcaagaacagtgttgtagatagagagtgggtcacatggagtccccaggtaacgtgtgaagctatctctatcagtcagctaaggctgctgtaacaaaatgccacagactgcatggactatgcatggaaatttattttctggctgggtgtcgtggctcaggcctgtaatcccagcagtttgggagaccgaggcaggcagatcacttgaggttaggagtttaagaccaacctgatcaacatggccaaatcccgtctccactaaaaatacaaaaattagctgggcatggtggtttgtgcctgtagtcccagctcctcatgagactgaggcaggagaatcgcttgaacccaggaggcagaggttgcagtgagccaagatcacaccactgcactccagcctggactctgtctcaaaaaaggaaagaaagaaagaaagaaaataatttatttttattttctaacatttctggagactggaagtccaagatcaagagtctgcagcagagtttgtttcttctgaggcctctctccttggcttgcagatggccaccttatcactgtatcctcacatggacccatcctaagagcttaattttaaattaatcaccaccaaatacagtcaccttttgaggcactagagtttacggcctcgacatatgaatggggggacacaattcagttcataataggagcagaaacacacgcactaatcaaacataaaataatttaaaacagtctagaggtcttaaattgtgcctctctctgagtgtagacagtgcatggagactgccctccccgctgctaccccacatcctgagcgttctgtcctcgtttccactgttctgctccattgtgtgggaggagctggagaagagactctgtttccaaggaagtgtggcctatgctgctctgcacctgggccttgcgacagccgctgcctccaaccaccacaagtctactgctgttcccactaataagtaccatggaaacccagtgcatgccaggggctgtggagaggtgggtgaacatcaaatcaccagtgacactggcttttcaaacgtcacatcataaaaatagagccacctgagtaagagcgggccacagcggcatcctgtagctccctgttttttggcatctacttcccttgggctcacagtcttctccatgaccagcaggaagactcagcactgcaactatctgcacgggttggtcgggctacacatgcctttccctagcatattgctaacactcaaaccagaaactgattaatttgatttgggttaaaaaatctgaccccatgaaggctttgctgatcattgacaaatctatccttcaagcattacagttttaagatagagggatgctgccttagtctctgccttttttgccattaaaaaaccttgaaaatgttatatcatagatagatacattctaataacagccccaaaactgatagatctgcatactcagattattgatcccaatactctcagcagttttaagccccgcccctgcccaaagggaacccctaccaatttaattcaggaggcttttggatttcatttaatgtggatgttatcttgttttgtttctcactatctgatgctattaccatcttaattaggttgaaaatcagcaattagaatcagaatgcctgtaatagttgtttttcttttgatcatagttatactcttaatgatgagattatgatgtgtgtgtgtccacgtgtgcatgtccatgcgtgggagtgtgtgttgtaggaagagcagtggatgttaagtcaggaagataagcttgaatgtgagttttgcttcttctaagatacctgaacttgctggagtgagcctccaggagccccagggtcctcattcgcaaaaagtgagggaatggctgttccttagattaggctgctttgaaatccatagatatcaaaccatcttataaaccaaggtgctgcacagattaataactgacacattggaagccgaggagtgtttagatatgtgggaactgggggcacattgaaatcattactagagggtaaatgttatttattctatgagctaattgcgggatttaaatttgggagctaaattttatcttaaatgttaaatattgtacgtaggaactggtctttggggggacaaattcaagctagtaaggactgttagagaggagaatgatgctgtgaaaatttaaatcccacaatgttgtttactagaaagatatccatttccaggcatctggacatgaatttctcagcctttgagaaaagccaacttaaccagcatgccctttcgatatgattgctccggaagcgtgggatgctcagtttgaaactgagttgtatgtcaatctctgatatctcaatttctgacacactgaacacaagcaggagaagagatgtacctctaaagagtgaagaactctctctctcactttctcgccatcctatctcgtgccatttctctttaggttgattgtttttaagaactggtgctcagtgcttagtaaagaatacttttctgaagcatttctcccaaagtgtatcttgatagattctgcaaactattaagtaagatttcatatgctgagatggtgtaaggtgatttatatttttggagaaagctaaaattcatcttactgacttttcaatctctccttattttcctcttttccatatagatatttagaaaagcaaagtatattagtagatttaatctccagaggatgagaatctagggctttttttttttttggttttctttaaagattgtatgataaaaaatgtttattatggcttaagggggaatgaaggtattcagataagttaattacatgaacaagcatgcctgattcctcttccacacagcctgtctcaagatccttcattcgtcaactatttcttaagcacctactacttgccagatgctgttttaggcacccagctccagagctgcaataatgatggagattttctcaaacccaacacccctggagcttacattcccgtggagaagttagataggaacaggtatacaagtaagataatttcagctattgagacatgctgaacagggttaggataaaaagtttgaatttatataggtgttcgggaggccacagctgaggtcatggtagttgaaatgagttcaaattagaagaagccagaaacggcaatacctgaaacagaagggtatcagaaagagaaaaatggaagttcaaggccctcgagggactgaaaaatggccagcgtgcctgagcataataaacatgctaaggagtggtaggaagtgaaatgggagaggtagaaaaggtcaggcacataaggaacttggacttgattttgttgtaatggaaaaccacagggacctaggtaggggaaggtgttgatatgctgtatgtttttaaaaagccactctggatgctgtgtggaactgcactcttgaaagctacacctggagacaagaagctaagtgagaaggccactgtgagatcctggcagcttagactagagagtggagacatagtaggaatgtgtcctggaaggtgggaaagaggacttagattgaaggaaaaacaggaatgaataaatcaagactccctcctaggttcccgtcctcaataagaggagggatgataccattattaactgggatctggagggtagagcaatgagttggattgggtggggggatggggcgagggataaaagagtggttttaagcatctggcattctccatgcttgttaggtgtgcaagtgaaccttttgagaaggtaattggatattgtgtggaagggagggaatagacatctattgaaagaacaaatgatatttaaaagggtggtggtgcagggaagtggatgtggagacccacatcagcactgaaaaccagtgatgggattatgcacaccatatagactgggaagtgacagggaaattcttgtagatgtagtgcagtggggatgttactatctctagtttttaatccagcgtgcatttttaatcacatgggggagatacaaaaataatatacccatgccccaggccccactgccccactgtagaccaatcagtctcttttttagagggaagggtaatggcaggcctcagtagtttttataaagttccccaggttattctaacatgtggccagggttgtgggcagctggattagaagaaaggaagggatggcctgctaatcctgttaggagggtggcccctggaactaggaagtggaagtacctcagtgcaacctcacactcattctttggagaagaaaaaggaagaaagtgagggggaagccaagtgtttgagcagtggagatgggaatcacaagacccctgccagcaagagcctttattcattcagcatggttgtcacatcaggggaagagcacattctggcccctaaagacgacaatggttgaagaaaaggtaaaggacaacttcccagatagctcctcagtgacagccacgtgctggaaattcttcagcctgaggtgaggctgtccctgcaactgtcagactcagatccctctcatctccagggttggctgaatctactatctgggcaaaattatgtgcagacaatctaaatgtttactctctatgacagtttgtcagtaatttttagtatgggacccagggttattaaaggcagggtgacatgggctgcagtatgacttgatgtaaaatatttcagcatgcattcttatctttgaccattaattccacttttaggcctttgtccaaaataaataaataatacgtgtttgaagagtttttttttttttgtacaagggagaaatacttgaaatatttgaaaagatttgctgacatgcattttctactgtgtaggcattgtaaatcatttctttaaaatcagagcatgagaaaacatataccatgtaaggtgaacttggaaaaacaggtttaaagttatgtataactgtggttatacaggaagatttcagaaaacaaacattggtaataaatacaccaaattgttaaaagcagctcttgctgagtgattggattatggtcaactttaattttcttaaatttttcatttacattttattttatctcattttaaatttccttaggttttcaggcagctcagatatcccacagttttagtaagaacacatattgaaatagtattttaaaagagattgattaataaggtcttaattttagatgagtttagttatgcatttttaaaactccgattctccaaatttggaataatggtttctgcctctcagagctgttacaagaattaaatgagataaccagtggggaaccatgctgtgcaatccctgatccatgttacaatttctttagtatttttgcactattgcctctgcttctaccaaggaactttatcccatggaagtgctacctttcacctaacattttgttagtttacgtgaaatagtcaacagatatgaagatagtttcattatttatgctgattgaaatgctgatcattggtgcaaaccggcatcccagcaggatgagctgtgattgggtgaaacatccatcatgattccatttctctttgccagtgactggcttggggttgggcattgtcctcacccaggagaggtaagggggaatgtgctggtggcagcagggaaggatttcatgtcctaattaaaagagagaaagctcctggagagtgtgtgtgttctgacctgtacttactctctttcaatgggaccttggtgcctggagctactgaagctgccctgggaccatgaagctacaggcctgaagatgaagggcctggcccctgttgactccgtggagctgccaaagcaactggaggctgtccacctttaggcatcttgttgagtaaacactcgggcgaagtctgtgggcctctgatagttgaatgtttgtcatacacagtcagcagcagtgcagttgacactacctgtggaagttgacatctggttcccaaaaacaaatagaaaggttggtgggaggagaatctgctgtgtgtttacatattttaaacatgtatggcaccctaggtttttctttctttttttttttttctttttattttgatggaattttgctcttgtcgcccaggctagaatctccgcctcccgtgtccaaatgattctccgcctcagcctcccaagtagctgggattgcaggcgcctgccaccatgcctggctaatttttttgtatttttagtagagatggggtttcaccatgttgtccaggctggtctccaacacctgacctcaggtgatccacccgccttggcctcccaaagtgtgggattacaggcatgagccaatgcgcctggccggtttttaacgcacacttcttataagtgcctagcgggattacaggcatgagccaatgcgcctggccggtttttaacgcacacttcttataagtgcctagctaacttggcaaaataatttcatttggtattcatacaaatttactactttaaattactccagaaattaagccaaatgaattttggagagtctgagaatcttaaacaaatacgttgtgaattacaagtttgcagaactccatatccagtgtcatgtcctgagatttagattcgcatatcagcaaggctactgctaatgacgctggggttttcaggtggacactgattgccacagtcactgaaaatttcatttagctgaattcctggaaaatgcttaagatatttacattttgataatatagaaatcaagagttaagctaatctaaaatttgtttgtatgttttataggtatgatttacccaattttgctgtcctgagaggaaatattacaaatgatagctaggtttcttagataattggagaaagtgctgtgtaaacatcaaaatattcagggcatttgttattatttatgcagaaatatagccaaaatactggcatattttcagttagcaatataatagtaataatagaaagtaaaacattttaaaagaggtttttctggaaattttttcctcaggatcacaaaaagtttttatttttcataagtatttcagtgatataatgagcacaagatacgttttgatgaaaagtaatgtttacatgaaaaaggaaatgcttattgatatttaaagacaattccctactctctctccttttccacatggtgaagtcgggagctccagatagaaatccaaagagagagaaagacaggggcagggaaggtacagtgtggaataatgtggactgtctcacatgacacttaagaggtcatgtgatgctagtgactttgctgatgtgtcaaggctagggctgagaggctgtgtccagcactgtcatctccactacctgaggcagaagcagaactgcagccggggcctccctgtgcttccagcactgaaagtaaagtgaacaagggttatgtggtcaacatgtgtgatttcttatagggaattttggttttgtattactaaaatacatagggtctggtgcaatgactcatacctataattccagtgcttttgggaggaaaaggcaggaggatgtcttgagtccaggagtttgaaactagcctaggcaacatagcgagatgccgtctctacaaaaatgaaaaaaatttgtctgagcgtggtggcatgctcctatagtccctattacttaggaggctgaggcgggaggattgcttgagcctaggagtttgaggctacagtgataccgattgcatcactgcattccagcctaggcaacagagcaagactccatctctaaaaaagaaaagtaaaataaaatacatagcttatgtatctgaaaaccttcaccattggatagtaaaaattcaatttattataagatcttaaacagaatccttgagaaacttaaatatagttaactctaaggttatgaggagagattgtgggacttggaggaaaggttagtctgtaccccaaatcacatgatttttatagaaagaacacaaaggatggttacctgtgggcacattctggaccacttacatgtttacttaacaacagttccagcagttctctagtgtgtgtatgtgtgtgcgtgtgagtgtgttcactttataagcaggtaacttcctgcctatataaggtaactttcacggatttcagacagtgtaattgtagttactgggtagaagaggtctttcatgaaatttgcaaggggatctctgcgtattttgtgagtttcctcattgttctctctataattaacctcacagggcagaggatagtttcttttcttatagatccatatcacaggcatgattctccagctgaattcctgagctcaagatttcctttctaaataaaggaaagggaaagaggattttctcgaggtaatggacaagagttgggaaaagtggttgcagatatgcttgatgctaaggaagccctggtgtatggactgttatgtgttccctcatcccctaaatttctgtgttaaaatcctaaccccatatgctggtattaggaggcaggggcctttgggatgtaattaggtcatgagggtggagccttcctgatgaaattgatgtccttagaagaagagagaggagagggcttgctttttcctttctctgctcttgggcatttgaggatacgggagcaggggatgtctgtaagccaggaaggtggccctcatgaaatagacctgccagggcctcgatcttggacttccctgcctatagaataatgagaaataaatgtgtgttgtttcagccgcctagttcatggtatatttgttatagcatcctgcactaagacacctggcttgcagagtgaggtgccttataagaaggtaggatacgtggtttacacacaggtagccacagggtgcagggtgcatctgtaagtcaagtggttacaacctctgcctctctaggattaaaatctttggcactggagcgaattttatgatccatcttcctgaaggaaaccaataaaaataatagtaaaattgacaactaactacactgtattgagcatttcctaagtacttgtcatgggttgtaaacaacatctcactcagttctcagtacagtttgatgggacaggtactattatctccatttcactgaaaaaaaaggaaacctgaagtgaacgataattaagtttcgggcccaagttctcccttcttatgatatgatggttaggttttgtaaccagggttatgatttaaaaatctctgttccatttccccccatgaactcttcacttatactctaaaatatctcaaaagatgcttgtactacatgtaatatggcatgcgaggaaatggattttttaaaaaattttttagagactcagaggccgggtgcttcaggctcatttttaccacctgacccgcgggtacacagcatgtaattgtatctcaaaatcatttccagatatgttggaaagagcaataggaccagctgtgtttctcataaaagattaggcacaagtcatgtatgaggtttttctctactctgacttgtgaaagtccaagcagtgggttaacatgataaaggaaaacaaaattaaataagctggtgtaagcataacacaactgacttccagaagggagataaatgttgcatagagacatcatatccagccaaattgttgcctctggtatttccatttggctaatagtgcttaatattggttgaaaaataaaagtatgccgagaactcgtatatcatatggtcagcattgcatggtttcgaacactccagtgaacccatctggagagtttcagccaccagggcctgacagcctcattagctgcctccacaaggccttgcccaagcaacagtacaaattgctgttgtttcagggcgatggtgcagagttaaagaaaacaaacatgttcaactgttttgtgttttccatgttaaaacctaaagatggaaacctaattattcagagattccagcagaacactgagccctcactctaaatttttacagcagttatcaatgtgcttaagaaatgtgaatcaggaaagtgagtcacatgctcaacatggtaaacatgtatatatccaccttcaagacttcagagtgtgtatatatatatatatatatatattttttttttttgtttgtttgtttgttttggagacgaagtttcactcttgtcacccaggctggagtgcaatgatgcgatctcagctccctgcaacctctgctgcctgggttcaagcaattctgctgtctcagcctccctagtagctgggattacaggcatgcaacaccatgcctggctaatttttgtatttttagtagaggtgggatttcaccatgttggctaggttggttttgaactcctgacctcaagtcatctgcccgcctcagcctcccaaactgctgggattataggtgtgagccaccatgcctggcccagagtatatcttaataaattattatcacaaatttgcatcctcatggaatctgagtttggaggaaatctgatgagctcccagtttaattatcatccctggtataaatctcttgactgttcccagacagaaagggttgcttagtctctgcttggactccttcaatgctaagatctccttagactttaccttttgattccagatggcgctaatcattgaattactgtctcattagtcaaattccaccttctacgcctgttcttaattctaccatctggggccaaaataaggagcctgtccatgttccagcagacttttaccaggtgaggacttcagtcgtattttcactgggccttttcatttctcagataaatcagcaatcttttgtttctatggcagggtttcatgttccctgcagcattctggttgttctccttaggagtacagttgtttatcccaaactcccaaaccgcctcctttgtaaagaactgtgatcattggcaagtaatctcctctcagcccatgtttcctcttctgtaaaatcaggatatcatggtacctgcctcagagggttgctgtgagaatgaaaagagatgcagtgagttgaaacacagtacccagcaagcagtaagtgctgaaaaaaataagagcttctcttaccaaagtatctcttaattcttaatcccagtactaaataccaggcgtccagaacaggaccatcctgaccctttcatgcagtctcctcctcctcccggcttcatataattcatgaatttagcatcatgctctgctatctaactgtatcaaaaaaggaaagggctttcatttggctggatccatggttcatgagtccacatttgccttaagtgatcactgtttccaatttttatacacttacaaaccactcttcgtttttttccttagttcatggattctgtcatcttccccttgtggaaaatcacaaccttcttcatgtcttcagagttttttggcagcttttcccactctccaggtttcccattcctctaggtttgtagaacgtgttctaacctgcaaagcctctggctacctggatatgttattttttggaccacagacctgagttacagggttgagttgggaagttctctattaccgggcatttttttctggccttcccacagaccatagaatcagagaggagttgaaaaacaatattttcttttatatcttttagtgtcgtttatatagccaaagcaggagacagaaaaacacccttgggcaattcaatagaacataacttgagagacctggacctctgattagtcttgtacttttgtcataatttttggttccttctggaagttaaggccgtttcctactctgtttttacaggccattactggcaatcagcatgcagtttaactgtgcccagtttttgtgttttcttcatgtcctttgaaaatcagccctcacactatggctagattgaatgcattctgtgcatgcattctattctgctctaccctggtattgtttgtgttttttgcataattggaatttgccttcttaagaggtttccaaatctcttgggccatctttattagaggaagcagcactgtacaaatgtaaatagactttaaatatttctttagccctacagtttataatgttgtttggtcatgtttctttttaaagacttcgggattagagtaatatgtcttaggggcaaggagactcttctaggtattctttgtcttagtgactttattaaaagggtaccttgttgtaatgtacttacctcacaaagtttttgtaagaatttaatggctgttgcaattaacacgtaactgggtgttacagaacacccagagtagtgccaggcatgtgttcatggagtgttggctactactgctgttcttatcatcatcatcatcatcatcatcatgttcattggaaacgaaaatttcagtttcaaagaaaaaaaacagaccctgctcttcaatacagtatgcagccaaatgttcgtttcccagatgctctcattttgtcctgaatcacaattgttatttcaatgaagagctcctccttcattcaattgctattgttgtgaatactattttaaatagagtgcttggagaaggcctttctaaggatgtagcatttgagaaatttctgagaaagccaagaaactatctgcagggcatgtaggtgagacggggaagagcatgggcagtgaccatgccatgggagtatgtttgtcctgtgcagaaacagcatggcgtccaatgtgacatagagtggagcgaagtgggctggcaagaatatgttgccacgtgaggtctgagaagtagccagggtggggttacaataagaactttgaatttattctgtgagagatgggaaaaaattagaaactgctgagcaggagtgtggttggcttgtgtagaaaatagacgagatggaggcaggagtggaagcaaggagaacgtttgcaaagttatcacagtggtcttggtgaaagatgctattagcatggcctggagtgggagcaaaggagcgggtgtgaggagttctgatttcaaagatattttgaagatagtgtagagcagtgagggtctagaggattagtcagagagagaaatcaagtagaactggagagttctttgtttatttgtttacctgtgcaaaccagctacttttggagagagaagtactagagtaggagaggtttggagtggggaagtcagtcctttgttaaatttgagatgcctgttagacttccagtaatatatgtgatcttaggaaaaatagcaccatttgaagacttttctagcttccatttgttacctgtgtcacacctgatctgtttctaggaggatgtcaattatttaggagaagaaaaccaccaactaaaaatttaaacaaaacaagtaatagacttggtttcaaaatcatgatctgcttcttttaagagttataggggacctgcatccactgcctaaatgaaaacacagtcccttccaaatatacatttgattaattagaagctcaaagctctgtttttactgctttaagagaaaaaaattatcaccacattatagtggcaatttctctgatggaaactgaaatagtggatgatgatgatgatgatggaaatttcagagtagcacacaccttattgagtgattacattttaaaatatatgtgtattcatttattcatataatcgtttttaatgagagcactctcttaattacattatgacactgacttggtaaaagagaaaaaagatctctactgaaactatccctaaaggagctgatgttatggaaactgagatttttaatatttttagctgagaatatttatattaactggataactgcgaagatcacctccttttgactataaatttggagctgggttgtacagaattatatttagctctgggaaactaatcttaacagtgcatgttttaaaatagtaaggcttctcagtttgtacaccaaaattacagactccttgatacccttcttccaaaattttcagaagttgggacttagaaaagtttcattttgatattagagatggtatcttacagcactctgatttgaaagctagtacaatgaggtgactctcaaagaacaaaaggaatcaatatgcctaattgtgtttattgctactttttcatctttgctagatgctttagaagacaaaggccctctttaatttgttgatgcttagatgcatgatgtaatcttcaacagactgatctgcgctctcataattccaaagtttcttcccgattgcttgataaaaatgcaaccttaggtatgttttggaagacctccaagttatttcaatgttatgcaggtatatagaattaatattattgatacacatcttagcagtagaaacattttcaattatgattagaaaacatctttcttaaatgtcatcatttgatatcaccagtgatatcatagtgaatatttaggcaattttatccctgggcctagtccacacacatttttctagtaaagttgactaagacattcatgagccaatacaatgagcctatgattggtaacagggtggggaatgtctatacctttcatatattgcatcccaatattctatagtaggtattgaaacatgccgtacccacttctgtgccaaggagttttgtagaggtgatgagtcaggaaatccaagttctgatctgattctgttagaagctgattcactggctttgtacaagttatttcaagtttccagagattggtttccccagccatatgattacggggttcaaatgattgaactttgatgtttcatgttaaaccacctttgttcctctctatgtgggaatgggaaaaagtggacacctcagtctcgaaatagaagtttggggatgaaaaaggagagaaactaagtttgtaaccacagaagtgggggtcagacagcatggtttgagcactttcatgaatgcatctggtgtcagctgctggcctctaaaactaagtcctagtgttcacctgagaaggagttatctgtgttctctttcccatactgttttaccagtaaagatgatgatgagagaggtggtggtgatggtgttgagagtgatggggttggtggaggtgatgggagttgtactagttttctaggactgttacaataaagtagcacaaaccaggtggcttaaaacaatagaagtgtattctctcataggacctgaggctacatgtttgaaatcaaggtgttgggatgtacctctccctctgaaggctctagggaataattctttcttgcttcttttagattctagtggttgctggcaatccttggcattccttggcttgtagatttatccctccaatctccacctccttcttcacatagtcttctcatttgtgcatctatgtttctatgttcaaatttctttcttttttaaaacacactggccattttgggtttaaggcccattctactccagtctgaccttattttcattgcatctgcaaaggccccattttcaaataagatcacattcacaggttctgggtggccatgaattcttggggggatgttgttcaacccagaacatgagtggtggtaatggagatgggatggtggtattaacgggtatggtagtctgtggtgagggtgttggtgatattgatggtagtgatgatgtgggggtatccaagggttccatctcacatgatatgtactcagttgtagcaaaaatacttattgtacattgatccaaaattggctgcaaacctgtgactggttcttggcacatgcatcactacagagtaacaacaacataaaaggcctattgatgatgtcttaagggctctttgagaagtaaggggaggcagaaagcagttgtatcctcatgacaccgaggcagatgtttccgtctttaggaaggaagacagcatttctctgtacaaagcactttcagtttttacagagcaataatatttaaatgtaagacattcaacttgtaatcaaaatgggaaatagataataagacctttaaaggaaatatgcgtgatgcttttgtagtccatgttcaggatcatcttcctcttatttcttataagaaattttacaaggtctgtcctcatgtcattcagtgggcctgaaattgtatctgtttttccccttgctctaaaagttatattgaaggaatgattttgcactattgcacactaaaaaagcccctactcagaaattttaaaaacatctaaactcatattcagatatagtggagtaaatgaataattgtttcagccagagggttttctcaattagcattttaaggtcaaaatttaccctagaatcctgtagaatcagtggctgtgagtcacctactctttcctttcacataatctatttcttgctgtccacctactaggcaccaagtgaaataataccctttttatgtttctcagctctagcttgcagagaagagtaaagagaaataactactcagggcaggaagatatttgcaagaaggtagcaaacccccaaatccctttgacggtgggaacatcaaactgagcccttgaagactagagttctgggtactcaataatgttcaaagtaaaaatacttcagcaaattggatcaacactaatttataaactaaattaaacaacatgcattaaatgtaatctatgggaagccacaaaatattttgctttgcatattttttaaccttagtgataacaattcttagaccaaaatagaaatctccagtgttgcctgtttgtcaaggaagccttcttcattatatttcaggtggaactaaggagcacaattattttgataaacttcttttttactttttcattttctagagatagtgtcttgatctcttatgcaggctggagtgcagtggcgcgatcatagctcactgtatcctcaaactcctgggctcaagtgacccttccacctatgtctgtctcctgagtagctgggactacagatgcatgccaccatgcccagctaatttttattttattttattttatagagaaagaatcttgcaatgttgcccaggcagatcttgaactcctagcctcaatcatcctcctacctcagcctcccaaagctttgtgattgcaggtatgagccactgtgccaggcctctttcttacaactttagaatttttccataagatttctcctgtaggtaaagccaggttattcagtggaacttatccttggaatatatgtaaatttgtgccagcagatttttttgtcttttttatttggttgccaatgttatgatagccatttctttctcatcagtttggttcatgctgaatgccttgtgttggtgaaccttactgctatgtctttattagcaaagcctcagaggtatttcggcatttggccaaatatttgcaaaatgtgccagttagtcaagtggagaattcatttatttttgggcaaataatgggtttttaaaatgggattttcaggtaaagtgctactacatagtgaaagcctgctatggtgcaaagcctgctatggtgcaaagcctaggagatcaccaagaaccagcccttcccttccctccatttcctgggaatcacagtgtcccaggaagctctcatctttcattagctattgactgagagagatttttgcagctgcaatggaaatgccctctcgacagtgtcacttgcttttggtttaagcccgaaaaaggtacagcaggtcaagtcccatttgctgctgtttgactggagtgtgggcttgtgtgtgtcttcaccctctagcacagacttgttttttttttttttttttttttttttgatgagactacaaggaagaacacttttccttcactgcatgtattttactgttattattgttgaaaccattccttccacctccaacctttccccgttaccacacacacacacacacaccccaaacccgaaaccaaccacaacagcaaaaaacccaaattatataaagggcaaaggtaatgcagttaatctctgaattactttggattcctaacaaagaaagaacctaaacaagaacagcatctgtttaaagtaaaagaatgttttcttacaaaaaatattgttattgcttattttagaattgccattatgcttctgaaacgtactatgagagtaataaatgttaattaccagagattagaaagtgcaggcaaggagaaagataaaaaaagtctccaaaattatactcaccagaaaaaaacaatcaccgttagaaatctcagggtaatgctttccagatacttctttttctttttccttacttttcacatttttttcttttactttttgtattttattttatgctttggatggggatgtaggtatatgtgagtgtatttgagtgaacacaagtatgttttttcatataggtcatgatgatgatgatgatgattacaggcagtctttctctgttgctcagactggagttcaggggtgcagtcatagctcaccgtagcctgaaactgctgggctgaagtgatcctcctgcctcagcctcctgagtagctgggaccacaggtgtgtaacaccaaacctggtagatttttaaattttttgtagagatgaggtctccttatgtttcccaggctggtctcaaactcctgggttcaagggattctcttgccgtggcttcccaaagtactgggattacaggcatgagccaccatgcccagcctatacagaatattattttgtatcgattattctaaaacggcttaattctttcatgttctggtgggggagcaggtagcagagtgttataagagagaatatcccagaataagtgaccagagaaatcctttttggtgaatgacatttatggtgagatattaaggttgagatctgttgtcatgctaagaatggggagacgaactttgtaggtagcagggatcccagttgacaaggcctttgggtggaaggagagcttggctcactcatgcatctgaaagaaccagggggctgaagcacacaggaaactggagagacaagatagaaggtgggcagggatcagatcatccaggcatcttcaaggccatgcttgtttaacttaatgtattgtgactgtctttctgtggtcaacattctaaaagcggtagattttggtgttaagagcctggccactggagtcaaataaatccattgtgtaaacttagacaagctaattaatgtcccctagttttaatttccaaatctttaaagggagatgattgtaggcaatgtctgaagggaccattggggaaaaaaagtcagattatacgtataaaacaatgaagaggctggcaccacttttaatcagttttatggttgaatttattcaacactcattgatggagtaaccaagggcttggtcaagaaaggttatttagcagaagctataatggagcttcaaagagcagagcagtgaaacttgtacttctcctcctcaccacctttggaataatgagcccaggtgctccattgaccagcgtcctcatgcagagccaagtgctattactgtctttttaagttcttaagggcagaaccgtggcttttcttacttgttcttacccagcaccatactctcactcaggacttttttcttttttttttttctttgagacagagtctcactctgctttccaggctggagtgcagtggtgtgttctcggctcactgcaacctctgcctcccgggttcaagtgattctcctgcctcagcctcccaagtagctgggattacaagcacgcaccatcaggcccagctaatttttgtatttttggtagaggtggggtttcaccatgttggccaggctggtctcgaactcgtggcctcaggtgatctgcccacctcagcctcccaaagtgctgggattacaggcatgagccaccgctcccagccagcacttttgaagtagagatggttggtgaatccacgtggaatgtctgataaataacgaaagccaccgtgaatcacagccttttctttccagaagggagatcacacttttactccagtgcagactttatgtatatagaaaaattgaaacatactttaaaagatgtttaaaatatatttcagcttttaaaaaggaggttgaaaatctgtaaaattgtatgattccattaaaaacatggcatacatccagagctcttgtggcacttgtatcaagcggtacagctatgcacactctctaaggcgggcagctgtaagggctgtcctctgcttctggcatgccacattggctaaatatatcgaccatcacctctgcatgcacagcagtaattattgacgtattcctgatggttttctctggctgtgaaattatgggaaattaaatatagtttatatttttacaatgaacacgtattacctttataataaaaaataaaattaaaaatcacttaaaatttcttcaattcttttcacactcctcttcatgtaacttcatatttgtatccagcactcacaactccaaggaccatgcccacgtattcttttagaattttaaaaataaattccagtaggtctttcaaatactgaaatctcagcactgaagtagattgcagtggggcatctgatgggtacatttcaaaaatgctcaatttgctcttaggagacttgaattggccaggcgcagtggctcacacctataatcccagtactttgggaggccgaggcagcaggattggttgagactgggagttcgagaccagcctgggcaacattgcgagaccctgtttctgaaaacaaacaaacaaacaaacaaacaaaaatttaaaaatcagctgggcatgggggtgtgtgcctgtagttctagctactcaggaggctgaagcaggaggattgcttaaactcaggagttcaaggatgcagtgaactgtgatcatgtcactgtactccagtctggacaacagagtgatagcctgtctttaaaaacagaaagcaaaaaaaaaaaaaaaaaaaagaaagacatgaattgtatgattccatttttgctttggtcatttactgggtgtaaactcttgggttttccttatctgtaaaacagagaaaacagggcctcctttatgtgagttatagattatctgatgattcaaataagatatgaaagtacttttaaactaacgacacaaatactagctgctatttatttaagttatgattcattaattagtgtatcctgtgaaggctccagttttgtttttatcaaagatcacgtggagaaatggcttgcattgggataatttataacttattaaaagtttgcttctcattaagggactattctctttggaaattaggtattaaatatatggtttttgtggcaacactgggatgtgtgctgtactgctcctccctaaaaaaagatcttttttatattttaagcattaatcagacttgaggctatttgctttcccatcctcagaccctcaagtgcttgttgtaggttggattgtgcttgatattcagaattgagtataaaagcatgtgctctgctcgtggttggtcagctgccttggagaggctagattcttcatcatggcacaattacagaaaaatacagggttttcctgagtggccaaaaaggagatgaggtgggtgttgggcaattaggaccttatttctttaagtttctcctgaaattgttaaagtcagctcacacttctttagttttttttttttttgccaaaacacaaggcatcaaataatgttggaaaatatccttggtgctcagctacagaagtttcttgaatccacaagtaataaggagctatttggcatcattaaatacggagtgtgggtttatcactccagtaaatgaatcaggagagaatactgagttagcttcctgctgagatgtggaggacacctggagtttatctagcacctctctgtgagatccctgagagcctcctcgatgagaatgcaggtttattccttctacctgctgaggagacagaaaattagcatgataatggtgataattgttctgtcctctggacagcctggacatcagggaagctttgaggtttcagtaaatgcttacttattcctctgctcttggtacaggcccgtctcttggtcaagatgagagatacatagaaatataatataagccccatctgtaaccatatgaaaaaagtaaaaagaaatagacaaattaattttaatgatctcacttaacatatctaaattattatcatttcaacatgtaatcaacataaaaattaatgaaatattttaaattctttttttagttgtatgctacatattcaaactctggtgcgtactttttacttagagcatgtctcagttcggactagccatgtttcaaaggccttttcaccacttatggctagtggggaccatgttggacagtgcaggtttattccttaccaacctggcccatagtagaaagtgctgtttccatgagacagcctttactcctcagtaagtatttactgggcatctaatatttgcagtttactacattttggttatataaccatataacttgaatttaatgaatgaatcaagaaacataataataaatagtataagtaaagtttctggatatctgtttgctaactgtatgatacagaagcagctgagtatgagttttcatgaatttgcagtgtagctttgggatcatccaagttacaattataggctaggtgacataaaagacattggcattggggggctttgtgtagcatcaggaagagctagacagtcatctcctaaaagcaggtgaaactgaaatagaataacgaacccaagggtctgctgtcgaagagatgtagtgtactatttaggtgtcagagactgaaaaaatacatagtgaaggtggctatgagcacaaactctagtagaagggcaggcattgctaattacaggccttgatttgtatttgaggcacatcttttcttgggcatctcctgagttccatgaggacagccaatgagtagtgcctaataattgtactgcctttctgccaggtgccaactcatgttcgccaatgtttgaatacattttcaaacttaatttttacaaaaaatgtcatgaaataggcactattattatctccattaattaatgatgaaattgtaaatacactgatgttaagaagtgggactaggaccacatgggtattaagtagagggaccaaaactttggcccagttttatccaaccccaaaacatataattttagcttataattctcttcaaattagacaataccatggctcaaaatataaataactagtcagagattaaaacatgtatctgtatgaatggagaagcttgattgcatgtctgattttaaccagcttagattaaaattaaattattaagtgtacttaaattaacttattcaagaaccaattcagaggccactttctataaagagccccacttcaagtcccttatttggaatgcatctctccttcctcggctctccccaaacaatttacacatctcttggtgcataataaccttctcttttgattatagttatacatgagcatgttttatctgccttttctctccagccactacgtgtgtcttgtacacaaaatagctcctcaaaatatgtttcaaatagatgaactaaatgactagatggatggaaagatgaacaaatgaataaataaatgaataaaactattcctgtccccttcaaaataagagaagtgtttgtataaattaccttgagagtaggtaaaaaccctttgcaaaaaaccccaggggtaaaaccctttgactatggcaataatatgcaacataactattgtaagaggagggcagttttaaaaattcaaatagtcatgtacttgaaatattaactattcaactatgcgtgtactggtttatcatccagcacatagatacagtttgtctttcacttcacaaagctagtttcatgcattttagaaaacgtgtttttccctgacccccctccaagctgtacttgacagggacaaaactgagagcattgggcactgcaggaatcattgtgagctttcaggaggggaaagtcatttctatgactagtacttttcaggagacatgggtgtggttttctcttttcgcatgttttagacaaaagtggcggactgatgagtttaatacaatggaataccatggcttgtgcatgagggagtaactttttacaggaatgtttattatctttgtcatccgaatccatatgccatgctcagaaaatacaatggatctgtgtcccgagtggaacagaaatagttttttcatgctgaaatgtgttttggtcaccatttgacatttttaagaagcagctctgtgaaatatttttgaaagtggatttatgtattcatattcattcatgtgctgttttttcatctatatattccccatcttattccagaaaggatttaagctggctcatgcatttgttgtatttggaatgtttctttataggtcaaggactagtttcccagtgaattgatttaaagaactgcagtcctctgactcaggcttgaattcacatatgatattggccatttgggatatctctctgttatatgggcagagtaaacacaagtataaatctgtgacaacattttggatttctcagatcaggtactccatcatctgctttttatcacgtacaaaagaaatacaaggccatttatttccctattaccctgtgttctggatttttctatttataaatgatattttatatgctctgtttagcagttagtaatgaagcataaagggaagccattttaattaatgccttatttgcatgtgtagcatgcacctcttttctttgatattattggaaaattattttaaattcagtcaaaagaagatgctttaggcaaatgaggacttgctgatagagagctgtattattttattttactaatgaaatgctgttaattttttctctgtattttacctgctgcaactggtttccttgactttgttcatactactaggatttttgcaaaaaacaaaaacaaacacaaaactggccataagcattgaatagaatcattgcaattttctgtcaaacgagttttgaaatacatctggtgtttaacaacacattgcttatttatttatttatttcaaatcattaactactattgcatcataacaaaacacacacacacacacacacatacatacacacacacacacacacagctttggttcaattatactatatagccctcctgtttccattgtgtttgggggaagtaaatgtaataaatatttttaaattcagtaacccatctgttgaattcttgttggaattaactgagagtttgtatggaaaaggcttagcctagaacttcatatgtatgggactaggggatagagcacttgaagggatggcatgggccccagggctgaaaagaagtgctgagttaggataggatataagaatatataagaataggatataagtgtggcagcgctgaaaatcagatggacattgcttcaaaaccgagcgtcgacacttgatctgatctgcctcttaaacctctttgaacgtctcctccctaatctgtgatggcagaatggtaatacttattttgaagttgtgtcaggattggtagcagcgtgcagagattacagcatgtattatgaactcataaataacattgcctggggtgttattttcattaacttcatcatcatcatcatcatcaaatataatccattgcttcaaagaatttatagtctagtaagggataaaaagattgtgtgtttgtattaaagatggggtggaattcttattaagtatcaatttcattgccaacatggacatggcaaatgacaggttcccccaaaaattattgagggaaactgagattagatattgaggagattttgggacaccaaaaccaaggcaaatgaagcactaaggcactcgacaaaatgagacacccatgaatgtccagaggtatcacctcagaagttggtctgaggggcaattacacaagcagagctgagcagaaacagtggcaatgaggggtgagtgcagccaaccaggaaacctgccgtcaattgtgttttattcttggcaaggccttatttgaagttttctttcttgattttgttcttccccgctactgctagccacatctgacagatacactaatatacgaaaaattaaataacaataaaaataactttataagacgtgcctcaaggcagaatgaatatcaagtaccagatgatgatggaaagaattctgctggagttcagtggacacagctgtcttatggcctgaggtgtaaggatgacactatgagaaagggagccttgacttcacttttgaagaagtgtgcagggagcacgctgggaaaaggagggctggaaaagagatgagatcttgctggatcaactgaagcacctgccacctgcttggcaggacaggaaatcttaaagtcaatgctcctcacccttagcaccctgcaaccaaaaagaaaattcgaagggttcctcactctatttgattggagttttgaagaatctgtggcatcgattcctggtgctttgctgcccaggcacccctaatcttagcccccaccactagggggcctccctctagtctccttccttctaagcattgatcacagcccactcaggtttaataagcatgactatccatgtctaaaaaaaaaatgatactttatgacatcaatttgttgtgaacttttcaagcttttcttcccaaatagcatatggatattcaatttggaaaattttgatataggtttaaacaaaatcaaattcaaataatctgtaattatgccaaccccagaaagctaatgcttttgcttatttttagatatacttccaaatttataatattatgaatagtagtacacgtcagtaagtacacatcttatttcacaaaacatgggctcacatttttctaattcatcttattcacttaatgttttgtgaacatttttccttgttatacatctacttcagtaacattttttacaatctgaacagaaattaattgtatagaacagaacaggattcctttgttcatttttatatatgtttcttctaatgtttttctcataacctaatatgaaagtgataggttgtggctacatgtttacttatattcataataacattttaggatatattttgccagaatgtattttatggtcaaatggtatttacattttaagtctttttggtatgtatttgcaaattgattttaaaatattgatattgatttatgtgaaatgggaatgtttgagagtgccccttcttggattcttagccaatactgaggcttgttataataaataaataaataaacaaataaaagccttttctcccactttgatgggagaaaaatgggattccatcatattgtcatgctaatctccactaattataattgctaattgtattatttatttgtatattcttgattgtgatttgtttgcttataatatttgcctaatcctggaggtatttatacttcattatcttattttagatagttcttaatatgtattaataatagtaactccatctctgaaagaaatgccaagtagttttgcttcacatagtctgtctgcttaatatctatctggatttttccccaagtcaaacctcttagtcttttcttttatggtttttaacttgttaagtaagactttcctcaattccaattattgaaatatctatctatctgtctacatttatgcctactatgtttatgattggattttttatttgtaagatttaatgtttcttaggttatttttgatgagaataaaggatccagtgtgtaattttgactgcttgtacatatttagtctgttttgttgttctggccattcctttttagtagcaagcactataacattcagggaaattttcaataactagtaatgcacatcttaaaaatgttctgactgttttcacttcttatgaaatttagacttatttgttggaactccaatacaatttctagtgaaactatgaatggaaatgacatttatgttaatttgagaagtaggttctttgcaatatcattttttatcctatagcaacatttgtctctctattcaagccttcttttctgtccttttgtggaaatgttatggttcccttcatataataaggtcttatacagtatattcccaagtgtttgcattttatccttgtctcatttcttgatttaaatggaatgccccaggtattatactatccagtttaaatgcccactattgctatttagacattttaaattaggaatcaatgttgaaatagttaacgactttttttgtcatctcatcatttgttaaaaaattttttgacttagttatattaggggttaaatttagaatcccttatattggcactaacttgatcgttttttaacaaatcctcctatgataatgttttgtattattacatgacttttttgaataacacaagtgcagttttgttacatagatattttgctcagtagtagcttttagtgtaaccatcacttgaatagtatacattgtaccacttaagtaatttctcattccttacaccctcacatccttccacccttccaagtttctaatgtctattattccacactctatgtgcatatgtacatattatttagctcctacttatagtgtgaacatgcagtatttgacttttcgtttctgagttatttcacttaagagaatggcctccagtttatctccattgctgcccaaaacaagacattgatttaataattaggatttcagatttacattcatataaaaatttgtctttagttttttcttttcctgtctttcggggggtcaggtgtgggcatcagttgatgctagattcttgatttgtaaagcattccatccttttcagtgctccagagagaaaatatttgaaagaatttacgtgtgagctgggtttggaatgattgttcttaaaaatatttttaaatgtcccaaatatttgctgacagatttatagaatgtctaggatttgcttaaaaagagcctcaggaacagcatggagggaggatctgtgggagtattataaaactctgagtatatgggctggttccttgtacattgttttgcttttatacatgtttgacatattcaaaaaagtttctaaaaatgaaatcacctgcaaaatgttttcagtggtggttacagattttctaatgcctctagtaattttggtaatttacatattattaggaaataatgagagtttaatattcttaaacatgtgtttttatcaagtctcctgtgtctaatatagtgcatttctgttttatctcttaatgagattagaatttcactttaaaatcatctttctaactcacaactctgatcagactacctacctgtgggcaactgctttacttactcaatcgaatttggaatgcggtggcgcgatctcggctcactgcaagctccgcctcccgggttcacgccattctcctgcctcagcctcccgagtagctgggactacaggcgcccgccaccgcgcccggctaattttttgtatttttagtagagacggggtttcatcgtgttagccagaatggtctcgatctcctgacctggtgatccgcccgcctcggcctcccaacgtgctgggattacaggcgtgagccaccgcgcccggccgaatttggaatttcttgtggggtaggcaacaaagccttcatgcgctgactccaggtgcctctcaaacctgagccccagctttgttttctcctccattttcccacactcctaagagacacttggaaattcttcctcctcagcctggggtgctgtcagctgtaaaacagtgtccatcttctccaagacccccggagaatgctgtttctcttaagccttccacaaattcccccttgttttatcttctgtcccttctctgaaccacataatgttttgttcagactgtggtatagccttaattgtactgtatgacgtttgcatgtttggaaacccaccttgttcttttttccacctactctgctagcagaggcctttgccctcaggtggcatggggagaatatttatagggtgagcatgtagaaacaggctgcgtatgtgccttaggccagcagtcttgttgtatgtctgcagcactgaaataggtgctcgttaaatgtttgtaggatgaatgctgagtgaatgcagtggacaggatacaggcaggtgattgggagcccagtaggactgaccccggtgggattagtagagagaagtagtgggagataacttggggtcatgttgtcattcacagtttgtggatgggagcaggtagggctggtggtgactataggaggcacagaacacgtacacagctcttgctcttcagaggttaccacaacaatgtgtatcttttccaactcataattagtagaaatgatgtttgtattaaggtaacagaaatatgctcctaaagtactttctcattatatccaaatcactttatcatcatttgttttactgtagttacaccacaatgtaaataaaagcatttagaaagacagttgtctgaacttcaaagctgtttacatagaggacatttgctagactgggcttttcctccatgtacccttgggtgagcttgtggtcttccccctaaagatcacaggctattttacaagttttcttgtgagctgttcagctttcttataagcatgagttacaccagggagttcatttgggtggacagagtccagaaatgtcctgtttcgactggtttgtttaagatggccatcaacatgtgaggtagggaatgtggactttctattatggggctttttaagactctagaccatcgttcgaattaatttcgttagccaaagttttaggccttttgtccagtgtgctcatttgcttcttggtttgctggtattattcagatcaaagaaggtcggtcactggaggaaaatggccagcatccataacaatgtgtacagttactgttgtttaattgagtggatttcctgtttgataattactattctgtagttcttgtgtgtgttttgaggatgagggaggagggacatatatgacatttgtatatttgcaggtgaaagagaaaaaaaaggcctaaagaaggggaataattaaatatgcttttagattgtcaagcttcctttcagtcctatgctctgtgtgtttgattcaaagctatttagagaaagtcatcatttgacccctgtgagatttcttccctgttgtgcttcaggtctcaaagagcttccccagataaattacaggccattaattgttaccaccaattatactggcagacatcaaaatgattttattaaagagctgtccaaagatgtaaaagcctatcttgacaagcatgcagccatgggcagtgtaatcactcgggaggcatgatatagagggaattgaggcacatgtggaacctttggtctagtctgactttcatcactttgtgcaacagaatatagaattgggaaactccatctaggaagcagaattctgatcacctgtatacagttccaaagcaagggtttgaattaatcatttctgcatttccaagacctaacatggcatgatgtggaagcaatagatatgtatggacttggatctaattctgaataattgattataattatcatactccagggaaatttgtaagggctgccacactgaggttgtgcttgcaaatatgaagtgcaaattggaattaattatcctggtcttttttagggaaatactttcttttgtcaatccagatgagtgatgaaaaagtaccttctggatttgaattagctggataattcttgactttgctcaagctttaaactggtaggagctttaatggctattaattagtgtgaaagctttttattttctgaaaaaactttttttttaaaaaaaaaagagaaatccatcttgattgacagatggattcctctgttttatgttttattgtttttgaagaaaggaactttgatttcctgccagggagctttcataaaaggaccttagcatgctgagccctgattaaacatcagggagacatgatgattcttttgtatagctctcccctcaaaggtgaagaggcctaaattacagtgactgtaagagaggtatctgctgaaggaccatgttcagctataggaaaaattggccgtggcatagacagcagtaagattgggatgcgaatgtaattttcctctatcttatgaatatttaaagaaaatttgtagaagcaagggccatattgctactttatttatttatttatttattatttttgagatggagtctaactttgtttcccaggctggagtgcagtggcacaatctcggctcactgcaacctctgcctcctgggttcaagtgaatctcctgcctcagtctccggagtagctgggattacaggcacccgcaaccatagccagatactttttttttgtatttttagtagagacaggttttcaccatttggtcagattggtcttgaactcctgacgtcaagtaatacatccgccttggcctcccaaattgctgggattataggtgtgagccaccatgcccagcccataatgctactttagagaagagaatatccggttaagctagagagtgatatagagaatttacccacataactgaaaactttttataagataaaatagaatttaatttttatttttttttaaggatcctgctaattttagcagattttatttatgccacatgacaagtgtttgtgtaattaaacagctcactttgttctgagtttactatgtttgcttcccaatcttttattgtggaagtcctacttattaaccctgccttcccaaatcagttatgaagataaaggtgtaaactaaaaaacaaagctggtttatgagcaaggttgagtaccagaaggaatggagttccctaaattataagagtttaatctccagttttaatccgtagatgtaccctgactgccacttattagtcacgtggccttgggcaaggttttaactactctgaatctcagtaaaagtatataaatgagataataatatttacccggaagaggggttgtgacaactcagtaagataaagtgcataaagggccgagcatgctctggattttatggcattgcgtgtggcgacagtattgtaatgtaatgacttaaaaataaaactaaccaaggagattctaatcgatgattggatcattgtgctccctgttaggccaagagataaaaataaattactagagaatttttgggtcaatggcaattcttcttttagcaagtataagatgaatatgatcatatatcctttacttacttttggcttgacacaaaacatatgcctaagctgatcaagaattgcttagaaagtaaacgccaaattattttttctgtttctctttttttcttgccttcataaactgaattattaatatcctatctgctgtaatttttattttctgtgtaaaggagaatggtcgtagtctaaatatccacctctgagaacttaaaggtgggtcaaatgttctaaaattacaacacctttgctaaaatgtcaattctgactattaaaagtgaatattaactatgttgagatcaacttaatatgctaaaaatgaactatatttgggttgctattaattaatgagaaatagaacaaattaagttcaagaacattaaaaatctacccaactttacatatttatttacttagtcattatttatttattttaaatgatagactttgtgtcttcgatttacaaaaaaattgattgggaagttcagaggttccataaactccctctcacccttgcctttagtttcccctaattaacgtcttgcattgataatactgtaaaccaaaaacaaaattctaagcccctcaactgactgatggaccccctcttggccatgagtattccaaagtaaacttgaaaagggagttcaagccaggatgcgaagaggggtccagtgtgcctcattatactctcctctctttggaactcagacacaactgatcagcattaaagttaaaacagagatcttaagactgagaaaacagattccttgtagcaataagataccaaattccaacctaataataataaatctaagtgacttttattataaataataaattggtttttacatatggattcatagttgtcaccaaatcaatacatctttacaagtaaatcacagcttgggttcaaacagattcaactgcaaatcttaaagaaatatattgacctcataataagctaaactgtacttattctcacttaaccactttgtgaaacagtttatctgctggttatttttaaaggaagtaacatattatgtagcatctacagtttaatgatgtacattctagagcatttgtccttaaccccagcagcaggttaccaccacttggaaagctttttaccagaatatccagagcctgtctcccctgcagggattctgattgaaagagtcactccacctccctcctctttctcaggtagtgcggagtttccccaggtgattgcaatgtagacccagcattaggaccaactacatttgggtcttaaaaacctcaaaactgattgaagccaagagatattaaaacaaattatttgaaatagctgtataaaaatccatcataaagaattgagtgctttattttaaaacataaaagctcatggcttatcaaatattgttcccaaattataaaaacatgaagcaaatataggaataacatgaaactgccctccctgccctacccttatgggtacatgggtacattccatgcagtagcaaaaatgtataaatatcctaaatgtccaccaatagagaagtgattgaataggtgtcatgtataatcataataagagccgtaatagtattttaaaaggtttaaattttaaatatatctctatgtactgaaatgaattataaacattatcagttagaaagtaataagacaagttaaagaacaatttttttttgagagtttagctctgtcaccaggctggagtgaagtggaatgatcatggctcactgcaacctggccctccagggcccaagtgatcctcccacctgagccttccaagtagctggggccacagtcacacactaccatgcctagctaatttttaaatttatttgatttgtagagacaaagtcttgctatgttgcccagtctgtcttgaacttctgggcacgcgcagttctcccaccttgacctcccaaagtgttgggattacaggtgtgagccaccacagggctgagtcacttttttttaaattgacttttctgtcaagcagagtggcctacgtcatgacatggaaaatttagtcaattatggtgaacaacctaataaatatttaattttgtgtgcagacaacctccctctccatctgttcttctcctcctcaatgtttctaaaatccctgcaataccaatctaacaaaagttggattcctctcaaatggaccttgatcatgtgcctaagaattaaaacataataatcctttgagaaacatctatgaaagatgcagtatgaaatgttgagaagtgagtttgtagcttccataccatgcttcggttgaatttcatttccaaatacccagcggccgttttgcatggtgtagctgggctatggagcccaggctcctcatgatgggttgggtgactgaaacacatttttttcttttaggtgataaccagctccttcatcaggcttctctttcccaagtttaggaagaagttgactacaatgtatttccctagcatgcctgttcccttgaacaaaggcaggttcaggagtgtagtgaagctccaggctccaaaaactctttcactctcattgcactctatccaatgtttcttaatgctaggcacagcagaatcacctcagtttattcctcaaaaatgatggttgaatttatctggccaggcattggtagtttacagaagtctaccagatgattctaatgtgtggtcaagactgagaactatgtgtttaattgggttcatttcaagaatactgtaaaaattttatctaaatactaaatatccataaaagaaacctcggtaatcaggccaggtttttgagtttttccagattagcccaactacaggggaaagagactttcgcactatatcccagagtctctgctcctgcttccagcctcaatgcactgggcctttctgctgccttggagcacttagagggattacaggaggagtgatctgtggagttttatctgctgtagacaggacctctcagtgatgcatgcagtcactgcccagggtgcagctggggaagtcacataccgtttcaactcaaactggtacactgcaattcagttctcataaccatctggagttagtgcagaccccataagttaaagagtatggtctccagcaagatggtcctcgcttcatactcagaggctgcaaatccctgagcttcccatgacgttcctgaagctcaaaaattcactagaatgacacagaattcaggaaagcattatacttacagttttattgtagaagatacaactcaggagcagctgaatgaagagacacacagggcagtttctgagagggtctcaaacagagcttttgtgctctcttcttgtagaataagggcttgtcactattacctggaaaaaaaaaaaaagaaaaaggaaacaaaaagacaaaaaacttggttcatttgcctggcaagtaacaaacgactctccaggagaacataggttttgatctataggagttttattacttgtcccaaggtaggagaacaccgggaatattctccaaagcagtgtctccccgaggaaaagtgacaggtgggttttatggagttgtggagaggggagaaggtgcatcatcgcatgtagaggaggggcaccagtggtgcagactgagacattatgccagcacataggttacatgttatggtgatgaatctgtagctcctcccagcgtagagactttagcatggtaatgaggaagcttcactcagattcatctataagttgctggggtctgtctggaactggttccagctgactaggtgactgcattccatggacggtttgtaaaaaacaggctgaaaagtgggaggctataaaacaggctgattgttcaagctggttaaacttctatagtccctggagaccctccctgtctgcttacatcactttcctggcacattgatgtattcaccaagcgggaagtttcagcaaacttccctgttcattacatagatgtaattgattaaacattggccccattattgaactcaagctccaactccctcacttttctggaggtcaggctggttcagagctttaactctctaattacatgttaggtctttctgttgaccagcttccattctcagtcatctcatctcatgagcataaactcaaaagtttgatccaagggatcatgaatatcaaagactcttctattacctgggaaattccaaggatatagattctgtcttccaggaaccaggttcaaaggccagttaaattctttattatgcaacaaaagatttccctgaaaccagacttagaagtcttgaaagagatgggggattcaatttccacacaatccctgggctctagaacaaaggctgtcatcactgtcctcccctggtccaccattttgggttgtggtccctctctctccttgggaactttttcaagaatcagtattcagtcttccaggggctcttcattttacttctataccttgagatttatcacctgacggtgcctattcttggatttccacacccacactctttttactattcattctctaaaagcccaactaaacaaaacacaatcagatgaacctcatcgttcccccttttcccaatagtacttaattgcccattaacaggagatgaagtttcggaagatactcactcccattcttagagagaaggaagtgtttattctgcatgcacttttaagaaaccaggcagaaagcttttttgtttcattgttcaggagagattatgactaaaaacaatgccattacatctcccattaaaaagagtctgaactctgggcaattcaggataaggcacgtgtataagccattcttgtgttgctataaagaaatacctgagactggctaatttataaataaaagagacttaattggctcatagttctgcaggttttatagaaagctggatgctgatatctcttggcttctgtggaggtctcaggaagctaacagtcatggtggaaggaggtgaagcaggagcaaacacgtcagatggtgaaagcaggagagagagattgagagagaggagagagagagagaggagagagagattgagagaaagagagagagagagagattgagagagaggagagagaggagagagagagagagaggaagtgccatacactttttaatgaccagatcttgtgagaactcacgtcatgaagacagcaccaagccatgagtgacccacctccatgatccacacacctccaccaggttctgccccccagcattggggatttcaattctacatgaggtttagctggggacaaatatcccaactatatcagcatgtaatctactgcttgacataggtaagaagtaattcttcacaattatttcaaaaccatttctgaatttactttggaatctaaagttaatttggaacaatatattttatcaaattagctccaaagcgatatttactcatgcatcatccctctgaaatgtactctgcaggttgtatgttgtacaatcttaagtatttcaattacctttaagcaaaaacagtacaagaaaggattagtcattgctgaaaatattatagatcacatagattcatttccagttttcagtgttgttttttaagatagtaggtgtttgatagcttctagtcaccgtccaaagggtcatggtctttctgatctttttgttcagaaatttgttctttctggtcaggcacggtggctcatgcctgtaatcccagcactttgggaggccaaggcgggtgaatcacaaggtgaggagttcaagaccagcctggccaagatggtgaaaccccatctctactaaaagtacaagaaagttagccaggcgtgatggtgggcacctgtaatcccagctacttgggaggctgaggcagagaattgcttgaacccgggaggcagaggttgcagtgagctgagatcgtgccactgcactccagcctgggcaacagagcaacgctccatctcaaaaaaaaaaaaaaaaaagaaaagaaaaaaagaaatttgttctttctgatcacatatgactcaggatataatgaaagaggatcaagcctctaagaagggtggactgaagctagcacaacaatatgcctgctatatgaccatggcagacttcttcctagaatccttcagatccacgatcttatctaattatgtataattcccacagcagctctgcaagatagatacttatgtcccaattttgtagatcagaaaattgaagttaaggagatatgttcattaatgaataagatggtaagtagtagacataggattcaattattattattattttattattatactttaagttttagggtacatgtgcacatcgtgcaggtttgttacatatgtgtatacatgtgccatgttggtgtgttgcacccattaactcatcatttagcattaggtatatcacttaatgctagggattcaattattttgataattcaagtttcttccaaagtgtcctatgagtaattgtttctacggtactctatacaacatatactttcaggcacctcttctcagttggtaagtttgtaaagtgttttcctgattggtacaagatgaaagtgtatgcccagcaggttattaaaggtaagctaactataagagtcattcattcagtatattttttatagagtagcctgtatttctgctacaaatgatgttggcatatatgaattacactcattgttttttctatttaataaacactgaattatgttattctacaataatggcatggtgaagatggttaaaagtagtgacagaaaaatttgactttttagaagcctctaatttgtgaaattaaaggaatgatttcttctaccatgaggtcatagatattgaaaaccatttggatattgtttaaaccagtttaattttatataatttatttcatgagctttcaagtccgtatctccaatgatcataccagacagatccccaattcagaagttatcttgcctctgacagtgcttacaacaactaataaccaggttcaatgacagtgatccagtttcggcaggtactataattgcagattatactgttcatggtttcttctttgtgtgaatagtaagtgtatgaaatcttcagtcaacatttccttttctgttgcataaacagtgctgaaagcttaatgatcagctggagaagaggcgtaatgaatagttgcagcattgttcattaaacaccgtggtggttctttctttgccatcatttcatctgtgcttgaattttgcatttccttctattctgtcattctccttaagcatcggacactccctccgtggtaattgctgtgacacacataaagcttctatcatacaacaatggaaatgtctctccttctccttgagctcattttattggagacactgtacttttgaggatggcaaatctatggaaagtgactcatccaagcatactgtaatagatggagagatttctttagatatatgtggccttttgtacaattaagcactgtattgcttttcagtaaattaagagtaaaattttaagtaaattgggtttggaattgggatttgcaattttttgctataatttattttagatcacctattacttttttggtaattttgtttctactcttacataccttgtgttctacatattgacaaatcatgctctatttgatgaattacatctttaagttattggtatgttactataggtaatgtttttgtatcatcttcagtagcctgttagcatattatgacaacatgctattcctatctccccagggccaagcctcaattaactgctgacactaagaggccttcactccagaagtagattccaaaacacatgttgcaatgaatagaactactttgtatttcacccaaaacatttaagccatggctgtttattacattgtgttattttattcatggattaaagctttggaatttggtaaaggaaaagattcccagagactgctattgaaatttcctagtaccctttggtttaaagtgtagaggaacaattttccagataaatatggaattcgcttttttatgttgttctttagagagctttagcctatttggcactaagtataattatctgcaaatatgagtttgtttggcaagatattcatgtgtccttaggtattaatatgtcattttggggaaaaaataactcaatggagttctgtcattatatgaataatttgtgatgagtaatttcctaagcaacatcagaagcaccagatgacgatttttgtttttagtttgcaaaatgcatttattgtataaggatgaaaggtaagtaaggaaaagataggttttagtagctgagaaactttagagtcaggttatacttaggtggatttaattgccatactttgttatagtggctaaagtagcccatttgtcatctgtgacctatttcagggaacaacaacaacaacaacaacaaagaaactgtggataacatcaccccctccccacctttgttgttcttcttgatgcctatttgacagaaggattgagcactttctgtttctgttgcatgggccactctctctgagacttctcccacagtattcatatccctgcttcaggaccacctcctctgaggagccttcctgaccaacctgtataaccctttgttacacaaccctttgttcctccttggagtcactttcactgtccagcttctcaatttacccagctttttttcattatacttttcagtgcctgaacacacacacacacacacacacacacacacacacacacacacacacacagtttcctgtgttaaaatggttaaaatgtcagctctctggggggaaggaactggtttgtcttacccagtgttatgtccccaattgcacagcagtggcgtgtttcagttatggtcctgcctgtgttcaccatgtaagtgggcagacatgatagaaggagatctattatacttccttgtgttatgtgcctatggaatagagggaacagtggagaaagtgaataattatacctgggacctggggaaaaaactgaaatgagaactgacatgttaatatatgtcaaaagattgagaagaggctggggagaaatataagaaaggagaatttcactcggagtaacttggataaaatctctgagtttgaaaagagtatggaacattcaagaaacagtgaaccaaactgtgattggagttctattcccaacagttgcataagggaaactgaaatgaggtgggtctggagaggtagcttagaattaggttttgaaggagtctctgtaggttactaagcatgatcagcttggtgttttatgactgtattctgataactgtgaaagatggatgggagggaagcaggaaaggggtcaggaagtagacagtgtaagtgaggatggttgtgtgtacagaagtgagtgggagaaccacagatggctcacaagagaacatgtgagagagaccctgtgtcagctacagtttgtattagttggttgattagggatattattttggttttgctccgtaaggtggttggggccgaagctctttctaactcaccaccctgctatagtcagggtatgggccttgctgtcatggtccaaaatggtgattagtgctttaccctccacatctgttctaggcagcatgagggtagggtccaaaagatgaggggaggggaagccatgtgtaaattgtgtttaaaaaattattataaaaaacacataaaaaattaatcatcatgtcatgtgtacagtacactaatgttgactctatgcacattgttgtgcaacagatctctacaacttttccatcttttgcagaactgaacctcagttccctttgaaaagttagactactttagataactcacaaacatgaaatcgtgaaacatttgtctttctgtggctggcttatttcgcttcacataatgtcctcaaggttcatccatgttgtagcatataacaggattttcttcttttttaaggctgaacgaattctattgtatgcatagaaaacgtgttctttaaccattcatccacggatggacatttaggttgcttccacctcttggctattgtgagtaatgctgcagtgaacatgggtgtgcaaatgtctccttgaggtcctgttttcagttcttttgaatatatactcaggaatgggatagctagaggatatgggtaatttatttattttttttgaagaacctccgtatgtttccatagcagctacaccattttacattcacaacagtgcacaagggttccaatttctccacattcttaccaacatttattattattattatttttaataatggccatgatatctcattgtggttttgatttgcatttctctaaagattagtgatgttgataatcttttaatatgcttgtgggccatttggatatcttctttggaaaggtatttattcaagttgtttgcacattttttatggagttattttgttgttgttgagttgtaggagttctttatatgttctggatattaaccctttattagatatatgatttgcaaatatcttctctcatcctctaggttgcctttcactgtgttgactgctttcctgtgcagaagttttcaagtttgatgtaatcccatttgtctgttttactattgctgcctgtgcttttggtgtgatagccaagaaatatcgccaaatctaatgttataaagcttctcccctgattcatccagtagttttatagtttctgggcttatgttaaagaccttaacccatttttaactaatttttatatatgatgtaaggctagagtccaactttgttcttttccatgtgggtatccagttttcctgataccatttgttgaagagacagtcctttccctgttgtgtagtcttgacactcttgttgaatatcatttggtcataagacctgagagtttatttctgggctgtttcattctactgctctgtatgtctttctttatgccagtactgttttgattagtgtagcctggtaatatgttttgaaatcaggaatcatgaggcttgcagctttgcttttctttctttgttttggctattcaggattcttttagatgtcataagaattttgaaattaaaaaaaaaatttctgcaaaatgccatttggattttgaaagggatttcaatgaatcagatctctttgggtagtatagacattttaacaatattaagtcttacaatccatggccatgggatatcatgccatttatttgtgtgtgtgtgtgtttttttttttccagcaatgtcttatagctttcagtgtacaaatttttgcctccctggttaagtttcttttcaagtattttattctccttgatgatattgtaaatggaattgttttcttaattttcttttttgtttgttcattgttagtgtgtagaaacacagacaattttttaatgttgattttgtacgctgcaactttgctgaattcgtttatgagttctgacagtgtgtgtgtgtgtgtgtgtgtgcatgcatgcatgcatgcaaaaattttaaggttttctacttataaaatcatgccatctgtgaacagagatcatttcacttcttccttttcacctgttggtgccttttagttgtttttcttgtctaattgctctggttaggacttccagtactatgctgaatagaagtggtgagagtgggtatccttgccttcttcctgatcataggggaaaagctttgaattttttcttgttgagtataatgttaactgtgaaattttcatatatagcctttaatatgctgggtaattttcttctattcctagtttgttgagcgtttttatcatgaaagggtacttaattttgtcaaattcttttactgtatccattgaggtgaccatgagattcattgtcctttattttactaatgtagcatatcccattgattgatttttcatatgttgaaccatccttgcatcccaaggatagacctcatttggtaatggtgtgtaatctttttaatgtgctgttgaattcagtttgctagtatttttttagggattttgaggatttttgcatcaatatttatcatagatattggtctatagttttattttatggtagtttctttgtcttgttttggtattagggtaaaaatggcctcataaagtaagtttgaatgtttcctcttcaagtttttagaagagtttgggaaaggctggtgttaattcttccttcagtgtttgccagaattctccagtgatgctgtttagtcttgggcttttgttgttgttgttaggagatttttttattactcattcaataatcttactagttatagagctgttcagattttcatattttcatgttcagtcttggtaagttgtatgtttctaggaatttatcactttcttctaggtttccccgttgctggtgtatgattagttatagcaatatcttattcatctcattatttctgtggcatcagttgtaatgcctcctctttcatttctggtttttgttatttgagtcttctctcttttttcttagtctagctaagggtgtgtcacttttgttgatcttattaaaaaaaaaaaacccaaatcttactcttgttgattttttcctattgtgtttctagtctctatttcatttatttctgctatgatctttattattttttcattctgctaactttgagtctagtttttcttcttctttttccagttccttgatgtataaagtcatgttgttgatttgattttttttatagaaatataggcattttactgttacaaacttcttttatattaatgcctttgctatatcccatggattttggtatgctgtgttttcattgtaatttgtctcaagatactttctaagttcttttatgatttatttttgactcattcattgttcaagaatgtattattttcatctatttgtgaattttccagttttccttttgctgtcgatttctagttttattacattatagtcagaaaaagatgcttaatattagttcagtcttcttaaatgtgttaagacttgttttgtgctataggatatgatttatcttggagagtgttttgcatatgcttgagaagaatgtgtattctgctcttattctgtggagacctctgtatatgtctcttgggtccagttggtttgcagtgttgttcacatcctttgtttccttatttatcttctctctgattattaatgagttgtcttttttgttttttagagtcagtttcactctatttcccaggctggggtacaatacataatcatagctcaatgcagccttgaactgctaggctcaaactatcctcctgccttagcctcctaggtagctgggactataagtgtatgccactatgctcagctgatggtttatttttatttttattttttgaggagatgggggtctcattatgttgtgcaggctcctagtcttgaactcctagcctcaagcaattctctcaccttggcctacatgagttgtcttttaaggagtgtttgcagaagctctttgcagtacattggctgaatctcattagctctctttggtcatgcttacatgcaaaaaggctggaaaatgtagtccaattccaggtatcgtgcacctctaaaaataaggattatattcagaaaaagtgaagaatagataatggggagcagactgcattgggtctaacatattagatcagaatctaatatttttaaggtaccgaatgtatatcctatcacatcttgatttggatgaggcttttcattttatagatggaggaaactctgaagccttcccttgtgtgtctgtgatatatgagcttttaacttctcatttatgaagttacaatagatatataattcttaccttattgtgtgttctctaagaagcacagtaaaaataaaatgaagctttaaaagtttaaaatgatactgcagggaattcaagatgaaaaagatatacaatgccaaattacttccacccatgttgttacataccctattaacagcatgcacaagagacaattctatttctagattttagcaccccatttcataatttttacttgtgacgaccagagaatatgaagtaggaagatggcctgtggggagatattatgcatttttgttattgaatctcaccactaaaaattgtgtttagtaatcacttctccatcacctaaaaattggtaacaggtaaaattgaaacaaatttcagtaagataattttgtcattgggtacctcacttgaaatgtgcatttctgagtggagaggaagatggatgattctaggcaatttatactaatttctacgtgtgcatctattaatttttgaagaaatactgttagcgaaaactgtaaatgtataaagtggttctgatcacagtggaggaatggaataaaaattaaattgaaagcctctcatgtcaggctaagagatcgttttaaaatcatcatgcttatttacaaaagctctgtgaaactggtctaagttaaagaagaaagaaaatgagttttagattagaagtgagttatggcccctgcttttcctagcagtatgtccagtttattcacagtgttctccgcagttctggggcattctggggaaatctgttcaggaataacccatgatatcttcttggggcttggagagagtggtaaacagacatactgtgggtcaaactttgggatatccatcctctttcaaccacagagttagacattgatttttacatattgaacttctgcattagcatttccctggaaaaataagtagttctgaggcaaaagaaacaaaccattggactaaatcatgctgcttttatctctcctccaacagaagactacattttagaagtcattttatcaaactttagatcttctcatccttttccttcccaccacctctttgtaggcctaaaatttcatgagttattcctatactttaaaatatatgcttggtaaaggaagatttatctttgagcaaatgaataattcagaggctagaatttccctgagattagtttacaaagtgaagactccaacccagaattcaaatttctagggcagaaaagatgtttgtgctgtttcctccacataacagaaatgcgactgcgttttagtgctcattgtgaacacgttcttggaaaaaagaggtggaatgcaagtcccagcagaataggcacattgtatatgacagatgctacccgctttctgaaaagactcatagtcctcagtttttgatgtaagtaggactcattacatcaaatctctctttaagttttaaataaacataaagttgtttccaaaataatacaccccctctataattaggtggagaaaacaactgttatcagccgttgactacacaagatctatatcagtccttgatgccttccttgaaaattccatttttcttatacatgctttggattatcttaaaattagctagatttgttttacattgtgaagataaagatttctcaagtttcccaactctgttgagtcaacattgagccccttatctttcctcaattcactgatctagctgcaatttctcatgcaatttccaattttgtttatgccgtttgaggacctcacatataccaggtggactttcacattatactaacacataaggactacgaggacagcaataactgtatccagatagccaatgaatagtgaattcagctatgatataattatcaaaatataaatgtacaagtgattctttgattagtcttttgaggattaataacgaaagaacctagaaacattaatattaatcacattagtttttagaacattaaagttagagtcttctaaataagaacattttctaccggccagtttgtgttttctccctataacctctatttttgtgtcacataatttaccttatcacatggacatattttacactttacatctcttatttatttaaattacacaagtagtagttgcattaattgctgggcatggtggctcatgcctgtaatcctagcaactctggaggctgaggcaggaggattgcttgagagctcaagactagcctggacaacatagaaagaccatgtttctacaaacatgaaaaaaatagccaggtatggtgacacatgtctgtagtttcagttactcaggaggctgaggcaggaggactacttgtgcccaggactttgaggctgcagtgggctgtgatcttgccattgcactccatcctgggctactcttaaaaaataataataatttgacgcattaagtttttgggttgtatgtgccatctttaacaattcaggcttcccccttactaatcttgtggaaagcatctcctgaaataatctcttccaatttccgactaaaatggcattgaagagagaaaaagatgaaatcttgcaacttccatcccatttccattgcataccagcaggcagcctactgcctggatctgaaaggggatcaatgtaaagatactctgcctagattgtgaataaagcagaagtgacttaactttcataagacccataaagtagaccagtcacactgccccaagaaaggaagaaaaacatttcaggccattgttgtttgctgctggcctctgaggccaaaggcttcatcagctagaaaacaatgtatctcttaccattacaatcgtggtgctttatactgtagttaaggtacattcttccactgatgatttttttcttacatttactcacagcttccacctccaagaggaaagtggggggtgctctgaggaagcatgggaactacagatgacttaccacattgtgacaagtgtagtctccacagttttggggctgtgacagcaagaacgtgattgcaggtgcaggtgtgctgagatggttatgctccagtactgagagccataggacaggagagggaaggagaagcttctacccccgtttaacagagccacagtggatgagtgatttctgttcaccagacacgcctgtgacatctacctgtttttaacttcagacctgagaaggtgatttaacagtcactcaaatggcaagtaagcagacaaaaagaaatccacatggcatgcccaagggcaagcgtcagaagagacaacatagagctcataatatacaaagagcagcagtgcattatcaacctaaatgtttacagaaagagtatgcttctgatataccaacgataaactaaaataaaattttagaaagtcattgtatagctacaagagagttttaaaaattgcataatatgcagtgtctcaagaaatatgtcaccataacctttacttgaaagactaaaagaaaacttaatttgattttcagaaaaagagtggtgaataaaagtgttttaaaaactgaaaaattttagtatacatggggaaaatgttgtttgaaatggttaaacttaaagatattggttagaaatgtgattataaaactaaatgattggtataggttagtaagtgtcagggaaaggaaagtaaacaaaaggcaatgatatgcctcatcttttgtggcaggagtcaaaagatgcaattcatgctgaacctacataggctgaaaaacaaggctgatcttccgtgagtcagagggagtcaatttgaattataggatgaatgaaacttctacgtatcctgagctctaagtcacagatggaaattatcccttccagtaaagcacccatggcacattttcaaaaactggaaatctgtttaccacaagtactgtgatataaaggcaaaatccctcagtctggcatgatctagacctctggggtgtgacttatttttgcattttaaccctcaaccaccacttcccagcaccaaccatagttccatccagattccactgcccctgagctctaatggtgcccacccctgggatgatctcatttctacctcccccagacctccttccacatcctctgcagagaggccttttgtggctcacctacttctcagggctctttctcttcctgaatccttgttctggtcattgtctgaatatctcacttgtcacaactggattggaccttattttgtccattgttttgttttttttccatgacttggtgttaattcctagaaggtctggatcgtataatctttacttttcttcttccttattctcctcactccccttcctcctccttctttttccttcttttatctccttctttctccttcctcctcttactcctcctcctccttctaagtcttcccctgcgctaggctgtagctcactgttaatgcttggttcactgaatgaatgaaaacaagaaaagttgtaagagccttaaccataacactgagttacattttgtcttcctttccttgttttaaattgcgattttgcccataaatgcattctggaaattgagtcattggcatttcatagaacacataatatctttgctctgaaaacaaaagcaatcttatacttcaaatctttataaaagtagagttaactataaggccaccttttacatcttgatacagtaggggatggtgttttgggttgaattgtgtcctttcaaccccccaaatttatatattgaagtactaactcccagcacctcagaatgtgactttatttggaaatagggtcattgcaaatgtaattagtaaagatgaggtcatactggagtgggggagaccgctatttcaacatgactggtgtctttatataaaggagaaatttgtgcacagacgtgcactcagggagaatgccatgtgaggaaggaggcagaaatgagattgatgtatctataagccaggaaacaccaaagatttgcaggaaaccaccggaagctaggagagaggcatggacagatccttcagaatctctcagaacgaacctctcagaaagaaccaaccttgctgataccttgatcttctttttctgaggcggagtcttgctttgtcgtccaggctggagtgcaatggtgcagtcttggctctctgcaacctctgcctcctgggttcaagcaattctcctgcctcagcctcctgagtagctgggattacaggcacccgccactacgcccagctaaattttgtacttttagtagagacgaggtttgaccatgttggtcaggctggtttcaaactcctgacctcaggttatctacccacctcggcctcccaaagtgctgggattacaggcatacgcccagccaataccttgatcttaaacttccagactgcagaactgtgagataagtcctgctgtttaagccacctaagttgtggttctttttaatggcaaccctaggaaactaatatagatggtggttttattaagaaaaagaaaaataaaggcactcttatatttgtatgtttatattaattgccccggaaggctcttggcagcctcagaggttttatagcccaagtatttctgcagggaaggaagggacataccacatgatgaaaggtaagtttttggttttctgtaatctgattataagaaggttgtgtatgtgagtgtgtgtctatgtgtgtgtgttttaataagaataacatgtgcagctaaagccatgggattatgctcacaggttgctacactcatacaaaaatgaaaatattttatgaatacatgagctgtccatcatgggcgtgaatctgctgattaccatagtctctcatgctccgaacagacttcttcatgaattttgagttatgcttggaaaatatcttgcagttcaacaggccaaatataaaccacgggctcttgcttaggcacgggcctggtcttgcttagtatcgccatcttccaaaacctaatctgtaactgtactagcttcctagggatgctgtgacaaagcaccacaaactgggtggcttagaacaacagaaatgtattgtctcatcattctggaggctagcaccaaggtctggagtccaggcagggtatcagcagtgccatgctgtctctgaaactataggggaaggacactttttttgtctcttccagcttctggtagcctcagccagttcttggcttgtggtagcataattccagtcttggtctctgtctattcgcagtatccaccctgagtctcttcatgccgtcttctctctatgcatgtccctctgtgtccaaatttccccttttcataagaacactgtttatgtaggattgaagcccactccagcaacctcattttaattccatcagctctctaaagacctcatttccaaataagattgcattctaaggtactagggtcaagacttcaacttatctttttggaggtacacaattcaactcacaacagtaaccaaaatgacttttcaggctggtgcccagactgcctgtcatctgacagaattttcatgtatggctgttctggttgcaaatagcagggcctcactctccccattggccttgatcccattgctcatagtggcattctgacattcttacaatttgtataacctttgtgctatctaatttgacccgaaagccccagagtaggcatgttctatgagtatgttgggtttttttttttctagcaggtaacatttccagattagccgagccaaatgatatggtaacataatagatttccacctttgcacacctgaagtgtatgacctagtctaatcactgactgtggaaacagtagctaatatgacaaaagtgccgtcggggacttcagcacttcattatcgcagggatggcttccaaagctaaccccctcagtgagaaactcaggcatcccagattccaggagttttggaatagaaccccgtatttgtattgtgttggattgataatattaagaagtttacttaacttctccctctgagtgtgtttccattttaaaaataggagtgttaatgcctcctttgcagagtagagagtgctcaacacatggtaagtgctccttgtctgaaggttgcttattccactccctaatcatagtggctacaaaagatcatccttcagactcaagtaactgaagcctgtgggcattacatattcttgtactttttcttctattgtaaaatctgcaggacacttgaaagttgttgtttatgttgtttgtgttaaaacgcttatttttttaagatgatttttagattcacaacaacattgagggaaaagcgagatttcctatacagccccttcccctactcaggcatagcctcacccattatcaacattcctcaccagagtggttcatttgacttttaataatctccaaacccttagattccagaaaaaaatgcataggttgtatagtagggaagaaggtcatagtttatatttcttgagattatacactttctctctcaaaccaacggttctggccatgtgaggattttgtcactcccagctgatttggagatcatcacttttgcaatgcaatgtggaactcttgtctgcgtttagccctttctgaggacacattctgtgttttgctagactgaggcaagttcttgtgctttttgttgaaacaggcagtgctgtacagtgggaagatgctggaggtacaaaggaaaggccaggctgtgaatcctaacactagcactcgttaggcaagcaatttcacttttaccagcttcagttttctcaaagtgtgaagttagagggcaacctataggcccatcctcatttcccacactgattgcaaatttgtgggtctaatgcaaattgcaaatatgagaatcctcaaaactagccctaggttcgataatgcactaggaagaactcatagaatgtgctgaatgctgtaatactcacaggtacagtttattacagggaagtgttgcaggttaaaatcagccaagggtaaagggacatggggcagggtccaagaacatttccttgtggagcttctagttgtcctctccccagggagtatggacaactttacttttctggcaaaaacatgtgacaatacacatagggtattgtcaaccagagaagttcagtcaagccctggggtacagagattttactggggctccatcacattgacatagtcgaccacccacatggcagatctcaggctcctgtctctgagaaggctgagctgataccacatggctcaaagctctcaggctgaatcatactgttaggctcttcagtgtgacccaaggccctcaggtaaacaaagacgctcttattacatatgagaatcataagaaattacctccaggaagtcaaggactaaggccgtacctcttttggggcaaggttaataaattctttactacacacatagatagaacaagtgggtaatccttagcgacctgtctagtctgtaaaatctacagtgatgcaaatgtgcagccctgcttaagggcatagccaccgtcaccttgtttaggaactgtcagatctgccctctcatggccagatggctgcatcagcccactggtactctctgtgtgatatgcccgagggtttagggatgtttcagaaggctagttgtatctggcaaatgggtaactcttaattattgtatgacatttttttctgtatttaatggttaagatttagggaaggggcaatatgtgaaaaaaacacgttatgagaatgtttcacatttagaccttgagaaattggtatttatttatgccagttacctatgtctctgaggtgccaagaggatgaattaatattttatttcacttgtggagatattcagaaacattaaagtccttggtcctcatgagaaaagaattttcttgagacttgaaagcattactgcagacattttgctaacacattttttgtgagctgtgttaattgcacctacctttatcagtcagaagttttgctgatttaaatcagatcccagctaacccaagcggggctgcactgaaggccacatctctattgcccagatttcccaggggactctggaaattaaccagaagccctcctgctcgaagaccaactcttgaggcgtatatgatttgcatagaggttccaatgtgccaagttcttagaagtttctgggagccatacagatgattactattccaaatgttctcatcttgggttccaccctttttattcaatgagatttgacttttctactttttcactcccatcttcaccacaccaaaattcatatctaacagtcattgtgtatattatgaaagttggtctcaatttagtcaaacctgggtttcaggggatatagctcacataaaaaggaatgggaggtatcattatatggaaatacctgctgtgtgccagagcatcctttaaggtattttgttttctgtgatattttcaaaccctccactttacagatgaggaaagtcaggcccagagaggtcaagaaaatcacttcaggccaaacaaggtcacatggaaaagtagggattcctgtgaactcaccctgtgttcttcctactccttcatgctgcagaaactctccctgaatccaaatgatgccgctgctgaagtgtgggctggttagagtgcatcacacagagccaagcctcattgtacgggaaggtaaactgctgccttcagatggattttgtgtatctatggatatcatcagttgcccagcatttctgtgttatctgagaagtatttcattgtattactggcatgttcatggtgaataaaatggcaaaagtgttattaaattatattctttgctgtcccccaacacagctataaaaggcaacgctttatggaaagaatgatacattcaaaattcagtattcatcttttgctaacattttcctggtttgtgtgtgtttttatttgaatacatattattagtcaatgtagccataaactgaaaacctttgtgtttgaatttttgtaaattgcaatcttgcccttgagaaaaaaaaaatttaaaaatgctatttatgcttgttactactaattagggtggacacaaaacaatcgaatatctggatttgaccattggagggttacagattggttagaacatcagcatttatcatatttagatgactgattcatttgcagccagtcatgtggctgctgaaattttcccttaagtcaacgtttctgatctccatatgtaggagagtcgtaccaccgttcaaattggcattgatcaggaagggccaagagaattttcttcttctctttctgaagtggttttctcaggcaggactgagagaagcttcaacagttgaacagctgttgtctgtcctttttcctctctgtaaaatatttcctgatttgcactgatttcccttcctgagacttgaaacagcaaaacagaaacaaattaggtgtgtatcaggaatgaaatacctcctgtttattgagagtttaataataatctttgcaattagcgtttgacatcctggaaactcctactgctgagcttatacacacacacagaattttcaaacccaatgtggccaacacccccacagacacctggagaattcaactgctcctagaaaaagtggattggaattattttattcctttgcaaactttttgttgatctctaacctattggggtccaagcatgaaatggctctgttgtattcaacttctgacacttaccctccttaaattggtcaggaagccccttttgtgacgtcttggataaattttaaaactttttgttacagttgcttattttaagtcatgccaggtcagcaatcccattactgggtatatacccaaaggattataaatcatgctgctataaagacacatgcacacatatgtttactgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctccctcacaggtgggaattgaacatcacacaccggggcctgttgtggggtgggggaaggggggagggatagcattaggagatatacctaatgttaaatgacgagttactgggtgcagcacaccaacgtggcacatgtatgcatatgtaactaacctgcacgttgtgcacatgtaccctaaaacttaaagtataataataataaagagtcatgccacttattatgccttagtccggtccactaaaacaaacacaaagtttagttcttccttttcctttcctcaacctgaccaaatttgtggtgatttcacttatactattgaagtgtgcttgtgtgtgtgtgtatgtgtgcgtgtgagagagagggaggggagagagaaagaaggcggcaggggggtgcggagagagagagagacctcttttttaccccatgagtagagtaaggagaaagtagaagaaaacaggcatctccctgcttatgcaagacttgtttcagataactggtcacccaaatggtggtctcagcctcagaagttggcaccccagttagttcattcctgggtttttttgtttttcagtgacacagggcacttttttctacctgtgttggagtagagtgtcacaataatagctgaatggagccttgaactcctggcttaagcgatccttccacctcagcctcctgagtacttgggactaaaggtgtgcataccctgcctggctatttttttttaaatttttatttttgtagagaagagatcttgctatgttgcccagggtggtctaaaactcctggtctcaagtgatcctcctgacttgggattacaggcatgatgcaccacgcttggcctcaatcctgtttaactgacctcattggacacttggccgttaacttctggctggccaggctaatgcttctctgagctgtttgtctctctggcctcatctgcagcaggccctgcaagttggtcacctgcaatttcatctgccatccatagcactgactctggatcttgacaggggacttaggggctcacatttattttctcccctcctcttgcctgtactgccaggtcatttctctctaacactcttcctgaattccagtagcaaaggtctgtgatcctgtggctaggtagatacccacaatagaactagctgtttgtctccattcttgaagatcctcccaaacttcacaagtctgttggttgagagccccatcctttgcttgggatgagaaacctatggagaggggtatgccccttgaggtgatttctgtttgtctttccatccttctcttgatggctattatctcagtggaaatagacctaacaccccagagaatcttataacttggttctcagcagggctctgtctttcctgtaattactgtgtatttgattatctctggggctctgaaaagacctcagtctgtaccttccagtccattctgatacattcttgtgaatcaccaagtccatctctttttctatgttggttagtaacccaagaaaataggagattgataaagtatcacattacagaacatttaaatagtatcatagactccattgcctttcttcccagaatgtgagtcattgcctttgtgatgttatgacatagtttatagcaaacataaaatggcactgtttaattctgctctagtggtcatcaggatctgaaaataaaacatatcaccagagtttttgatgactccagtctcaaattttcagtttctttgatttttctaaaatgaaagcagaactttttcatcctgtctttgtttatggcttatgttgtctaagcaggaagatactgactcattaacatctcaacatttttggtagaactgtaaagagcttttcaactttttaatctgaatattgggaagtcagatatattgaattagacttaaaattgggtagtgattattgttcatttcagtattttccaatcaagctgacagttatgaaattctaaatcaatatatttgctttatcttttatatctttaaaaatagttaggcaggtatacaagagttggggtatttctatatatttaaatatttttaaaaataaagcatggaacattttgaattcattgtggatgagggggctgatgagagttgaggtggtaagagcagagttaatttaggaagcagccctgttgtggatgggaaatgtttgctgctaatgtctatttttctgtgctggagctgacagaaatttcctttttgtttatcactttgagccttttgaatactggcagtcatgacacttatgaaaatgtatactatatagttaatgtccttttttaatctcatggaagtgaagttattttctttctttgattgcatgcaatggatgcttctaaaaatcactctctagtgattcaaatattagattaacataccagtttgctgagtaaattctctgaactctatcagaacaaagaagaaactacaagaaaacaagctgaactcaagagcttgctttctctctctctctattttttcttttggaccccacaatttccagctatgtcttagggaatcagctccaaatcagtctgctgctaaaatgatcattgtgtacacccagaataaaacataaaaatatctgcattcacaaaaggaggggtgggtgtgaatgagggcattctaaaaaagggtttaggcattgtagacatttgttctagacaggttgttaaaaatcaacatgaatgccaaaatccaggaaaagaggaaagagcacttcacaagcagtcctgctcatatcaccttgcctgtgtcacaccagccactgctgcactgtaaccactagcagttttaagggcctcactttcacctaggattttgcatagcattgactgtcttgatatgatttcacatgttatttatgtcaggattcagattactgaactggcatgagttgtgctcatgaaaaaatataactaaagtctgtattagtgttcttcagagaaacaacatatatgtatgttctgttacattatatatatatgtagatacagatatatacctgttataaaatatatgtttgttctgttatattagacatatacctgttatataatatatatgttatatagaatatataatatatataatactatatatattatatatatatacacacacacatacagagagtgagagattttatcataaggaatttgttcaagcaattgtggaagctggatctggttaagtccaaagtatgaagacccctatttcccagttgaaatctgagggctggaagctctgtagaacaggagctgatgtcccagtttgaaggccatcagacaggaggagctgatgttcctctgggaggccaagttgtgcaccacttttgcagaaataccagtggccatttattttagttctgcatttcatagccttgtcaatgatgaggactgattgggatctgtatccagctaagggtgattatgagaattcaatcaaatgtcctgtcaatcttgacctgtggcaaatgggcttaaaaatcatgttcactagatttcattacagcatcttattctttaaatatattcaagtacctacttagtagctgaagaacaggctggaaagtgaaaatcacagcaaaataaaagttgatacctttgaggaattgagtgatcctgagtgtagccctgatttatcctttttttccagctaaactttctgtttaggtgatctcatcagattcatgactttaatattctccatgctgatgataccaaaatatgtttctcagactctgacttctccaataaactctgcactcatttatccagctgctccctcagtatctccaattatgtgtaatagacaccgtaagctttttatatccagaacagaattttgagtcccttgcctagaaaaatctgatcatcacctggtgttcctcatcttaattaatgacttcatttgtcctgttgcttagatgtggcagattgtatttctccaaatgaccacagcaaagatctcatcccacgtgcttttcttacagtgtaactttggtattcatcctatgagagttggggtctgtaatctttctgcttgaaactttgtggtggcttttgactgtccccaccaatagaatacagtagacgtgatgtttggtgacttccaaagctgggacaaaaggcaaaacaacttccctctggccctcttaggagatgcttgccctggggcaagccattcaccaagctccaaggaacccacactcgccaacatggaggaaccacatggaaaggccaactcagagggacagtgagttccaggctgaagccagcatcacttgccatagatgtgaataaaccagctttaaaatcattcctacctctagcttttgagtcatttggtgatggtccatacactagggcagacatacccttaaactttgagtaatttgttatgcagctttagtgactaaaacattgcaagataatgcattagccatcctgattcctctcattcacacacccatatatcctgtaactgtactttcaaaatatagcctgcatgctgaccacttcttaactgtccaccacagctggtcctgaacaccatcacctcttgccttatttactatagatgactcctaactggtttctctgatttttccctactacagattatattttccaagtagaagccagattgattctttagaaacgttcacaagatcaagtccctattttacttaaaacctccagtaacttcctatcacatttaacatactaccaaactcctcactatcccctattaggccctgtgctacctggtgtctttttctctgaactcctttctaccactctcctccagactcacaatactcaagccacactagactcttactcttccctaaaacattaatctctgagccatagatagctaacagcagaatacatgcctgtcttccatagctgtgggattgctcctgggtctgcaatgtccagctctctttgaacccataagattaattctcaccagtaacatggtgcttcttggatagggttattaggaagcaagtgtgctgccctcactctctggatgccaaggactccatagccctaggtgatggcaaaacttgaaggtggaggcagcctaggtccctgaatcaccacatggaggaaagctgtccatcaaccaggaacgcctgcattggactgtgaatgtgaataaaacttagggtgttgttaggctactgaaattttagagctcattcattatagtacctggtatttctctacctaatagtgttattccctcctcaaagcctttatattggctactgcctgctgctcttctctcccttacatcattctctcccttgcatcatgactctgccccccatttaaaatatttaaaatagtcagtgctcccacccccacacgaatttatactttgtcatactaccctgctttatttccttcatatacttatcactgtctgaaatattcttatgtattttattttacttccgtttctagtagaatgaatactttgtaatagcagggacctggtctgtctttctgttactctattcccagcacctaggtggtgcctggcatgtaccagtgatcagcatttgcttctggataggagcaattacatcaagtagaccgagaacaggaatgaagagttgggaattagggtctttggaaattaagttagcaccacttgataaatgattcaacttctcagtgccttctcacaattgtcaaattgggataatatctattttatggaatagtctgatgattaagtaaaatttgtatgtaaactgctaagacctatagctttttaaattaatatttgttcttatttcatgcaggtttggaggggaggaaataattgccaaccttaacatttattcttctaaaataagtgagggcactgccacatttgatataagtctcatagggtggcctttccagattggagtagtcaactactaggggttgttaacacttttataatatgaaggtctgttagtcagatactttgacacatactacagcagggaattttacagccctggcaattgttttgaccatcacaccatctctaaatgatatgatagaatggccacatcctgttctgactgagccgtgcaagttctgcctttattagtttccatgtggtattgtgaattcacagtttggtggttggaggtatgtagatgacaaatctttgtttattcagatctccaggaagcaaatggtattcttttgcagagtggccaattcaggaaaaacacgtttataagctattgttatgtttttcaaattaaaaacatgaatgaaacataagagagttatattgtaatactgaaaaatattgaggaaaacatgaaattctcctctcccttcacctcttccaagtttcctgtccaagaaaaacttgaaactgtcaaggaatttagtgggtgaattttccacatagatggtattgtgcccaagggagcaaagatttgttttggggaggagtgaaaaaattttactcatatgcgtaaagtacagatatacatataacacataaacagatatacaggctgggcatggtggctcatgcctgtaatcccgccgaggtgggtggatcacctgaggtcaggagtttgagaccagcctggccaatatggtgaaatcctgtctgtactaaaaatacaaaattagctgggcatggcggtggatgcctgtaatcctagctacttgggaggctgaggcaggagaagcacttgaacccaggaggcagaggttgcagtgagccaaaaacaagccccactacactccagctggggcaacagagtgagactctgtctcaaagaaaaaaaaataacaaaaccaaaaccagatatacagtctatgtgggatattaaaatttcatggcgaggggatttcatgggagtgattaggaaataaatgtctacatttctttaggggagtgatgatgaaatgaatatttcagaaacagtggtgtagtgtttatcctcctgttgccttgtttgcacccacacacaatatatatgtataaatatttttgttgttgacttttataatcattggaatatgaataaggaagaatgttgcacagtcactgatagtcatctgatgacaggaaggggacccagcattggcttgaggcctgtgttgtagatgtcagatcagagaactcccttgtgttgtcattgtgctactgcctcaaataactgtgaaacaaatactacccccaagaattcccagtctatgaaataatacatatcctcatggtttgaaccaatttgaatcatgctttctagcacttattcccaaaaatgtcatattagaaagcaccctataccaattaacactctcatatacatttatatgtgtgctcatatatgagattctcttcagaaaaaaaaaatctatactatatttgctggattgcttactgacaatttgtatcttattacagattgtatattaatttatactgctcacttctcctttggatttgttgtggttttcttcatgcttttaggacctttttatttttcctgatgtggtctttattgttaaaatatattgcaaatatgttctccaagtcttccacttttaacttcattttttttttagagatacagaagggcttgtgaaaattatgcattctaggttgtgtcttgcttagggagaccttcccagcccaatactatgaatagtttccactaacatcctttggtaaatgcatagttttactttttatggcttaagatgttacatagaggttacatgcatatatggtggatatatgtagagtgtaatgtattgtgtaagtttatttattttttccctaaatcagtaactcattttctcattaccatttactattttttacttttctcactaatttggaattctaattttcatatactaaattaatatgcatgcctgaatttgtttctagattttctaggtgggttacattcatttctccacattttcttatgcctatattaccctctgttaattactgtaacttctttgtgggttttgtgggatggttgcggcacatgttctattcacaatccttcttcacattgttcacttttaaatttttcttgctgttatgtattttaactcaaatgaatatagttttattgtgtttcagggttaggtgagcagagagagggagagttttcttactaaaatttaatttatttatgtaattgcatagatgactataacttcaaattctcatggctatttctttatccaataaattttttaatgttgtggcctttttaggatgtagtaacttaaaggcaactttcttacctttcaaccttctcatttgtatcccactttataatttaccgagttagtttgcattttctgatttcttcctcaatggaaccttatgaaaggtttgtaattttaatgtccatcttcagaagtgaaaactgaaagtcaaaagaatgaaataattgagtaagtcatatagcagcatagtagcagtaatggaactagaatttgtctgttccacttagtgcagtgtctcggtaattagaacaaactaattctggtatcaagcgttacactttgtttactggttaaagagacatacgagatttcctccatactgtcctgcagcctgggcgttcctttgccatagttgctggatcgcctccctgtttgaacaaaacaggacagaggaaaaggtaacctggaggagaatgccacatccgctgatttcaggctcgatgaagttcaacacttcctatttcaaggtggtgacaccctctacaaatccctggctttaggaagaaacctcttgataaagacccctcatccacagagttgcctccaagcctatccttgttctaatccttcttctctgcatgaccaaaacttggtattcaaaattcaatcttagtgttttctggctgtgctaaaggggatgtggggacctcatgtttggcttacctgcaccttctaagctagcaccactgtcttacttaatggactataatttcatctccttaagctctcttcagaatgctataatgaaggaggtgtgacttgggtttggaaatgtggtggcaaattatctatatatgaattaacatgtataatttaatacacatcatgaataatgatgaattgcaagtttaacttgatcatttaagtagagggtaaaatttctctttgtccctggtatattttatagagtaaatattaaaatttgatactctggctttgtggatatggtttcatgatgtacaaccactgtttctaggcagcccactccccagtatcacattgtagacaccttgaggacagggagatcttctaaatctgcttcatctctttacttcccaagacaccgtgaccaggctctagcatagaatatttgtttgctgaataaaggaattaatgaactaatgaactaatgaactaatactactttgcacttcacacatctctcaatttcctttatttttgtattcatttctagaatcatacagtgtaaactttaggtaacaatatagagataacacttttcccatcctgtgcaatggcattttgccactagcaggatgcaggagacaattggaaaggaaacagctttaactgtgtccattttggccagctgttctttgtaaaaggtctgtgataaaatttgatataattcagcacattttgcattagttagatattaatgttaactgataacttttgctcctgttagtatagaaggagtttattctctatgaacttgtcccacaagaagcactgtcaactcagaaggcagtagccgacgtttttggtatttgctccaggttccttttcagaaaaggtcattgttggatagaaaggcagcatgctttggtggctctaccaagtggagtctatgaatcatcacctggaactatgttaggaatacaaattcagtgatgcccttcagccctattaagccaaaaactctgtgtaggaccaaatagtcagttttaacagcctgatcatgtgattctgatgagcactaaaggttgagaaccttgactctgtggaaaaaaagccaggatctgaattgggcagaactgaatcagaattttagctcagccatgtattgtatggcttcagccatgttaaagaaatctcagccttggtttctttatctataaattgtggagcttaatacccacttcattggttattaaatgaactataaaatatcacactgggcctgccagtagaagccagtcaacacatttagggttgtaatttcctttcctcttgctaccaccattgcatgaaatctaaagtagaaatagtagtttttaatcctttagatatgttattatgtatgatagtaatgtatagggtttctataccctgagctttggagttgacacttttctgacaaaagaatgtgatttacttatgtattttagctgataaatcctagatagaaatgtatgttcccgtctccctaaacatagtagctgtctgtaatcccatgtgagtcagagatgttccagttattgactgctgcataacattctaccccaaaacttactaaacaactatttagctttgctcatgagtttgcaggtaagaaatgcagggaaagcttggctagcggagtagtctctgatcagtgtgttcttggctagggtggcaggggctagaggttcccctccaagatggctcctccagtcacatgtccaacctccttggagctggtcttgctctcacatggcatcccatcctccagggtctgtcctcttgttttaggatttccacagtatggtggtcagggaaaatgcacttcctgcatagtgattggctttcacgaggtaggtagtggaagctgccaggccagttaagacctctgcttataaccgacacaactcgccctgttgctcagagcagtcacacagcctgctcagagtcaagggagagaagaaatagattctgtctctcgttgggtgagtgacaagtcacaatgcaaacaaatgtgtgggatgggagatgttctgctcatctttggaaaatatgatctgccacgagggctcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccacgagggctctttagtagggaatagtatgttgttctttgtatgcagctgttaccaaaaatgcttaaaatagattgaatttaacgattacacctaaacatacatacatgtattttaattacgtttgttgtctaagttttgccttttaatccttagcaatgtaatttgagtcaagtcaggtgagttgttagtgtgagagtgagctgtcatgtcatccatccacgtccccgcttggactgttttacacgacgggacacacgtccactttcatgatgcagtgctaagggttgctctgtcaatgtaaaagctgtgtccgagcctcagggcatgtaaccttacagctccgtggtggagttacatgctttgttgctgaaggaaggaatgttttcattagttttctttatttttgttccctcagtgggatgttattagtcatgtagaggcagaatttctgtcctcctccacctccaaccaggaagtattaatcactgtttcatctgtgttttcgtagcatttgggttattatattattgttttttgctgattattttaatcgtacaaaaaatacatgagtacattctgtttataaaatttcaagcaataaaaataaaataagtgttcacattaatctgcatccattttcccatgctaatcccttcccagagataagcaatgttatcaattttgtgtacgaccctccagacatattctctgcatcaagatatacacagatatgtgaacatgtataatttactccaatggaatcatattctatatattgtggtttcctttattcatttaaccgtattgagttggagaaatttatatgtagaataactttattctttttttaaaaaacagctgcatagaaggagaatcacttgaacccgggaggcggagaatgcagtgagccaagattgcatcgctgcactccagcttgggcaacagagtgagactctgtctcaaaaaaaaaaaaaaaaaaaaaaagaagaatattagaaaattacaaaaaaattcaataaaaacatctgcaacaaattccatctcatgaccgtacagtagtgaatttaactcttcccctacagatgaacgttgagattgtttccagattttcactgaatacaataccctagtaaaaatttctgacattgttctttgtgcacctgggtgagtatgtgaccctgtgtctagaatggaatactggatcagacagtgtgcatgcccttatcaaagatactactgccagactgtcttccaggaaggccattccacagagagtcaaccccctaccacacggcctcatcaatgatggctttttttaatcttttctgagttttgcatatttgataggagaaacagatatatccagttgttgtctttccatttccatgttcattaattaggtgtcccatatttttccgtgcttattgagcatttgtatttcatcttctgtgactatgttttgttcattttattatggataccatagaagtgtatatgttttcttgaaacttcattttgttccattgataattattttattcttgggcccaaacatattaaaatgtaacatttacccatttaatattaatttaatacaaaatatataccaagcatcattgggcattagaacattacaaatacaagggtaaagaaaacagacaaccagctgtgttcctgacgaatttccggaaagtgctgaagtattaaaggtccatcctaggccatacctacatgggtgaccctggcacaggcctgagtttttgctggtggctctggttatagtatattttgatatctggtaagatatctgagaaaaatttctgtctctctctgtcatctatcaatgaattcttccatctttctatctactacttattagatgtggggacttagacaaattcttatcagatgtgtaatatagatccaggccatctggcttcagagtttatattctttcttttgtagatttaatagagtttatattttttcttttgtagatttaatataaaattgtaaattttagaacttgtcaaatttcatagaaaagtcatttgggactttgataggcacagtggggtgtgtaataatgtattaaatatttttatgatactgagttatcccacttagtaccattgtagaccttcattaaatcatctatgattttatgtcatttccataattttgtccttgctcattattagatttatcctcagatattttacaattttgtgctgatacaaatgggatcttaatagcattatctaactcctttatagtgtaatggaaagtgtgaattttttgtatgttgaccttgaatctgtatattttgatgatttgttggtgtgtgtcctaagagttgtgagttgatagtctttgatattctaagacaaaaataaagacagttttgtttctttcttctaatcttcctaactcttatttcttatttctaaattattattattatttggtgtatgtattcaggacagtattgaataagataagatgatggggaaatccttgtattgttttgaacattaatggaaatgctgacttttttctgaacatttagtataatgtatactttaccttggtgatggataacttttatcaatttaagtagttttttcatgctttttcttgtactaagagcttttaataaggaattgagtttgaattttataaatgtttttcaacacattcaaaggtaatttactttttatatcaattaatgaattgatttacattaatatacagctaaatgttgaactctttatccctgaatttctgataaaagctctaccttgtcataatatgttcttttaatatgctactaaatttttaataaatttatttttatataaatgtaatatgtgtatatatataaaatatgatattatgtatatataatataacctttttctaatgagtaaaaatggcccacctttcactgccttatcctcttgtttctggttttagtatcagggttaactggctctgtcagatgagttgatttttcttatattttctgttcttctatttatttatttatattttttgtagaaatgggagtcttgctttgttgcccaggctggtcttgaactcttgggctcaagcagtcctaccaccttggactccaaaagtgctgggattacaggtgtgagtcattactcctttctattttctacctttggaaacagatttcctaatataagaatgatcaagacatgaagtctgatagggtctacctgtacatcagtgcaggcttgatttcttcaagtcatcttactagtataccaactttctcagtggttattttactgtttagataattctctttgacccagttttggccatgtagcttttcctaggaaattagtcctatcttttagatcattagttgtatgaaattttttatactgcaagtaatagtttaataaaatcatatatgtgacatcattaataaatacaaattttatctatagctttgtcctttttcatgctatttgttttatatttgttctctctctttattgcttttaataggagataggttatgaaattaattgagcatgtttgtcttttcaagaacattattttaaaaaattttctattttatacacttaaggttttattttttactaattatttataactttatgttttgatatatttatattttaataggtccctaatattcattatgtatcatatatttgtagctataaattttcctttgaatacaatatcatctataattcataggtgttaagttttattgctgattgttgtttttgtataagtagtttgtgatttccctgataatatttatttaatccaagtttttaacagaagatttatcttaacatttttcccttgtgttttttattttattattgtataggttttttttctttcattgtttatgaatgttgaattttatttcataattgtgaatgggactttttgttaactttagaaatattctgagatttcctttgtattctgctacactgttattttaggtaatgttctatatgtgtttgaaaaaagtatgtattttcattgtggtgggtgaaaagtcgtatgcatattagatcaaattattaattgcattaaatatattctctatatttttatttatgcgtgcttatatagtctgttgatttcttagaaagttagattatccaactgtaagagtgagtgtgccaatttcctttcatattcttgatttttttcccatttatgtgtttggaagctaaatttttagttccataaaagttaatgtctttcatagtgtttgggtagaagaattttccatgttgtttaaatggaatagctttctttgtcttcatttcctattctttctacaatttctgagccattttatatgtctcttttgactgcatatggctgtatgcttaaatttccaatcagaaagacttgttaggggaattgagaccatccacaatattgtgtttactagtgtatttggacttgctcttggcagcactccttctttattatagtatgtttatggatatgcatataaatatattatgcctgcaatgaactatgaagcattattgcctggcaacatcaaccttagttttagttttattttcctagtagttttctcattttgattaaaaaccacagaatgtcagtggaaagaggggcccctgctctgtgccctgcatttgggcaggctctgcttttgttttgggcaaggagaataacaaatgcttggagcctgagccactgcctcaagcctcctagggcctggtaggcctcttacaggattctcattggccaaatgccaatcagtgagtggatgaccatcctctttagactctattctccccaataattaaactctgtcctaatcaatcactctaaggcatgactgtgggcaggggagagtgaaagtgatgggcagaatttggacttgggactgggtggtccacttaggggtgtattacactacttgccacgcaagttgaagctgagggatgagagtgagaaagtgagatgtcacctccctttttgttcctcttgcacagctctgacgttgggggactgggcacccctcttccagctgccgtgttttggcaggaactctgagaatgcttgaacttaaaactggcattttggatctttacgtagtggtatttccaagtaagaggaatagagcatactttatttaacaactttgatgtcctgacttactacttttaaacactaagatttatgtgggcttccattgttactcttacctcaggccacagacgtcatagaagagcttggaaaaagttaaattcttggggagaatagaatagaatctaaagagggtgatttttgactccagcatctctcaggtttctgtttacccacctgcaccttctcttctggttctgaggcaggtgcttatctctttggagatgtgctgaggcagaatcagatcaacagctcttgcagagaagacgaagtgaggcgaggttgttaggtctagagtgcagaggggccagattagagtagccctggttggtggaagtatcacagctgcaaggataacctgagtttcctgtgggttaagaataggtcatgtaaggtatctgactgaagccatcttgccaggtctcctgtcaacagtggagcattgttgaacagattatgaggggtaagagaaggacatgaccgtgcttttgctggatcttctgtgtcagggacctgaacaaagttttcctgtctcccctgccaccaccagcagagcagtgaagagcaaccaatatgtcctgagggagctgcttttggaggcctgaaacatagaaggaaccaataaccagcatgtgttagaggaacaaaaacaaaaaaacaaaaaacaaaataacagctgtaagtaataagacctgcaaatgcaaatcaatgtcttgttccccctaaaatcaataggtcccctgtgccttccggcacactcacacactgacacaaccacatctggctttcttactggtgtagacaggagggacgagcagggggagcagagagagagagaggaaacaggcttcttgaggcatttctagtctgagctgacatttcattttaaaatggaaaatgatacacaaaaaaatccagcgtgaccagaaaaaattataagcctgatacttgtagttgacaagagtaagttacctttcccgtcaccagttcacctggtgctgataattcagaaagcacatatagtatcaggtactagaaaaagtaaatcattccacatttgcctgttgctaggttgaggcaacttaataatacctgctgatttctctcatgtctggacattttgagtgtgtgtgtgtgtgtgtgtgtgtgtgtgcacatgcacttctgtgtatatctgtgcatgtatttacaaaagtagagtcttgtattccaatgcccgttttaactcaatctcttcatacagatttcattccaacatttgtcacaagatattgcactatttttttttagctgtctatctttactgctagaaggagattttttagaggagactccgatttaaatattgcttctatcatagtgtaagacatatagtagattctcaataaaaacctgtttcttacatttaagctagtgataatgtttgtacctattaagggtgctgaggctattttccaagacccagttggaagatactttaaaagtaacttttctagatcatctgttaatacttctgtagccttttacaggaacagaggaaaagtaaaataggcagtgaggaaggaagtgctgttatttttgtgcatatagcatagtaaatgtgtatgtacctggcatttactggtaaatcaacatgtcagagagatgttatttgttactggctctgtgactaattatccctctagatataatcagtgttaaaggtagtgaagtgcaaaataattgcaacaacaagacctatgattcatttcaaccaggtttatagagtaaaagattctttttcttaactttagcagttttttaattgattctgtaattttacaatggcaaaaaggtagtttgcagtgtaattctctattatttccgtattgcaaattcaatctatgttagatatttgatgccatgggttagcattttttatttgcaaattaagtattttgtgaacccaccatatgttgaatgatatgtagaacagaggcatggagaagccagaaatatttgtgtgtgtgtgtgtgggtgtgtggtgtgtggtgtgtgtgaaaaaaatatgctagaccaaggtatggagagtcagacttccaaaactgcatatctcatctgagtacaatccttctatccaggggagatttaggtttggtggggctcaaacctcatacaatttaggaagcacattttaagaataacaatacaaaattaagaacacaacagtggctgggcgtggtgactcatgcctgtaatcccagcactttgggaggtcaaggcggctggattgcctgatatcaggagttcgagtccagcctggccaacatggtgaaaccctgtctctactaaagatacaaaaattagttgggcatggtggtgggcccctgtaattccagccacttggtaggctgagataggagaatcgcttgaacctgggaggcagaggttgcagtgagctgagattgtgccattgcactccagcctaggcaacaagagcaaacactccgtctaaaaagaaaaaaagaacacaacattaagtattgtgcctatgcaagtgaagagccccgaggcttaagcttcatgcgcttctttgtaaatatttctctttttatatcaagtcagatttgatacttctctctgttggacatgtgggtatgtaatagcttattaaggtgaacagaggtcttggcatatgggtggtatagaagatgttgtaaaggtgaggacgaatttctaagagttgagatgtaaagtattgtttaccactgataaagacttgtatttataatatggaaatttagaaaacagagtgaaaatatctattatttaataagtaatggaaaagatcaactatgatgacagggacttacacttctggcccagttggagtaaaagagaccttctgaatgagacagcaaaaaagtaataaatggacagaatatatgaagcaaaggttttcaagatactgaacatcagacagtgaagtacagtgatcttgaggtaggaaacaaatgaggaaagtcatatgattgtgccagcctactgctttaagacagtttccaacgtgtagcacagggaggagaacccaggtggagcctggtgatcttgaaaaggagataaagctgaaaactgcagggagaccatggtggctagaatgcacaggacaaagtactggagagaagagatttgtctagagaaaagtctcaaaagatctgtaggtagatacattatgacagaagcatagacatgtgatagaagcaatatgtaaagggatgctttgggtatttagtagaggactgcacagcacatgcaggtgaggaaattactaggttttggaaataactacccaaaatggttagtgggaacaatacctgacactcacactgggccagggatagtgcctgttcctacctgtcgactggaaatttcataaccatcaggacattggatagtactcagagtgtcatgccttagttgtggagactaattaggcatagactaacactgtttgaataccacctccaaagttgtaaagcaaaaaataaaggatatagattattttcaagtaatgtaagtacattctatgaaggaaattaaagaatatctataggaatacaaaagtaaatatcaagcatcctacatggtaaaattcacaatgcctagcacccaatcaaaactaaccaagtatgcaaaaaagtggggaaatatgatccatattgagacaaaacatgcatcaagaaaaatccagaacagcgatagcagacaagaacggtaaaatagttattaagactacatatcctatgttcaaaaattaagtacaaagaagacataaaaatataaccaagtcaaatgcctagaaatgaaaaaatactgtttgaaataaaaaatacactagatgagattaatgtcagattagagactacaaaaaagtaagtgaattggaaaataattatttaaaataaagtaatagaaactatcatgaaataaaactaatagaaactatcatgatgaaacacagagaaaaaacaatgaatgggacattagtgatctgtggggcaacttcaaacatcctattataagtgtaattgtaactcttaatgaagagagggaggacagaaaaaaatgaatcaataacggttgatttttttcaaggagctcaatgaaccataagcacaagaaattggaaggaaaccacacaaaggaacatcataatcaaattgtttcaaaccaatgattttaatttaattgcatcattaatacaatgtaatttaatttaattttaaaaaacaatcttttttaacttttaagttcagaggtacaattgcaggtttgttacataggtaaacttgtgtcatggggcttcgttttacagattatttcatacccccaggtattaagcgtagtacccattagttgtttttcctgatcctctccctcctcccacccttcacccctgaaaggccccagtgtgtgttgttcccctctatgtgtctatcatttagcttccacatataggtgagaacatgcagcattttgttttctgttcctgtgctaattgctaaagatagtggcctccagcttcatccatgtccctgcaaaggacatgatctcagttttctaatagttgtataacattccatggtgtatgtgtaccacattttctttatccagtctatcactgatggacatttagacagattccatgttttgctattgtgaatagtgctgaaatgaacatatgcatacatatggctttataatagaatgatttatattcctttgggtatatacccagtaatgggattgttgggtcaaataatatttctggttctaaatcttcgaggagtcgccacagtgtcttccacaatggctgaactaatttacactcctaccaacagtgtaaaagtgttccttttactctgcaaccttgacagcatctgttatttttttgactttttagtaataaccattctgactggtattagatggtatctcattgcagttttgatttgcatttctctcataattagtgatgttgagcttttttgtatatgattgttactgcatatatgtcttcttttgaaaaatgtctgttatgtcctttgcccactttttttatggggttgttttttcttcttttaaatatgtttaagttccttacagatgctagatattagacctttgtcagatgcatagtttgcaaaaattttctcccattctgtaggttgtctgtttattctgttgatagtttcttttgctgtgcagaagctctttagtttaattagatcccatttgtcaatttttgcttgtgttgcaattgcttttggcatcttcctcattaaatttttgtccatgcctgtgtcttgaatgacattgcctaggttgtcttccagagtttgtatagttttgggttttacatttaagtctttaacccgtcttgagttaatttttgtatatggtatatggaaggggtccagttttaatcttgtgcatatggctagccagttatcccagcaccatttattgaataaggtgtcctttccccattgcttgtttttgtcaggtttattgaagatcagatagttgtaggtatgcagtcttatttctggcttctctattctgctccattgatctatgtgtctctttttttaccagtaccatgctgaagaaacaaccttaaaaacaaccagagaaaaaaaagacatattacatacagaggaaaaatacaaggatgacacaagatttttataccgagccaagcttgttatgactgtggcatagtaagccaatcactgagacaacagttttgtcatggagaataagttttagacaaaaagcagagcaacaaagagatgggaaagcagctctaaaatccccctccccgataatggagttatagggctctttatgggataaaggagcaaggtggtccaagacatggggaaaggtgattgagagtaagaaaatatgaagcaattgatgatctgcacaagcatagtcaagcttcatggttcttcataggatgcatattcacaaattatgtcattagcataatctgagagtggagtttttggccctctgacatcaaaaagtcacgcatctatactcacacaggcccatttggagggtcagtggtctcagtggcttgaactggatgagaactaactctaagttcctgaaaaacaacttaagtaattgttaccatggtgacatatatattagagacattatgtataaggaagctagtgggagtttagttaaacttgtttagccacctgacttttagctacataacgtcttaaaatcaactgaaagcaagtgactaaaacaaggcagagtaagttaagttgggcaggcctaatctggtaagccttcagttttagtatcttattggaaacaatgagaaatcattggagcacggtcttgtggacatatagctctacacacagcaatgaagaacactggaaaggctttgaaaaaaaaaagaaaaacataaaatacaatgaaaatataaaacttgttttatccaaggtgccagtatctctactgtttgcctactgcaatgccaggatctcagagacaaataaaaaatgtgatagaaacaatcccctatatcagtagttgagaggacaatgcaaacaaatacatcagagaatattatatgagctcatacaattgtgtaacatctatctatctatctatctatctatctatctatctatctatctatctatctatctatctattcatccatccatccatcccatggtaatgcatgacatttatcatggcaggtgtctcagtctgggttttcccagaattatatcctaagatgagggttagagtgcaagtaaatcacttgggaagtgattcctggaagcaccagcaacgagtgggaaagtgagatggggaaaagggaaaggcaggccacaaattaaagtatcattatcaagaagataaacactgtgtgcaactagagtctaatcacaccaggaaattgtggatcagtgtacagcagtggcctcaggtggaacttactcttgcagagagaatcatggccttccaaagacaaccatgccctaatctccagagcctaagactatgttatgttacatgtcaagggaaaattaagatttcacatgtatttaaggtcactaatcagctggccttaagataaagagaatatcttgcattatccaagtgctcccaatataatcacaagggtcttttaaatgaggaagaagaaaacagatggtgaaattcagagatagatttgaagctgtggctggcttggaaggaagggggctataagctgagaaacagaggaggcctctagagctggaaaggacaaggaaacagaatcttttcttgagatttcagaaggaatttaactctgttacaacctgattttagcccaattagacacattttagatttaataccttcagaaatataagatatttgtattgttttaatttaccactaagtttatgttaatcccttacattagtaatagtaaactaatatacccacttgaggggtgaggtagttgggtatttataacacataccattggttggtaattgcttctgtatgtggaaagaaagtggcccccaaaagagagagaaagccctttggttgctggaggttagctaataggcactataaaggtaaggcctgctggaatgtgggcactgcacttactagtaaaataggctggcctccctcttcctgtcctttccaccccttcttcattcatctaacatttctcgagcttttattatgtaacagactttatgctagatgctggaaatagaaagacactgtatacatttctagcctagaaggttcaacaaagaggaaaatgtttacatttcctagattctcagttctagactctaggatagattgctgagatatttttcatcaatggaaagaaacacatttttgttgggtttttcaaagaacgtgacatgacacaccatttttacaagggataattttagtgcagaataaaatagagcagataaactgtcacccaaatgaagaaatgccacatttattgttctaaggcgtccagagcaagatatctttttggtatgaatgtgcaattctacacacaattatttctttcttggatgtgagctaatttctattggacattaaattctataggaaggtgaagattagtctatctggatgcctgtttgtttttaatgaagatgttacacaaaataaaaatgaagagcatctgataaacttgtatacaaacactcacacacaaatcttctttaggcatatctcaaggtatttttccttcctcataatgtgctatttacacttgactcataataccagtttctaggtatttcagaatacccagaagtttagcacaaatacaacaatggttatgctacagtggaaatgaagtaagcaatagatgctactgcagtaatttttgaaatttctttgttcttataaatggtcaggcactgcattaaaatttggaagattgcacacttgcagcctctggtgacttcccagattgaatgaggtattgcctccctcatactcttgtaacaatctttagacctgtatttctcccttccatgttgtagggtagctatttatttaatgtctgtctactgcagtaagccgtgtgtgctcctgaaagctgggttttgataatcttattgttctttctctggcatctagatcatgcttgacatatgttaaattctttaaaaatattcaccaaatcagtgggcaaaagaagttgacaaactcaagcaatgtatttcgtatttattattttataggcttaaagtagacaattttgttctgtgttggctgagttaatcacttgtgaaaaacagcaaaattatattgaatttcaaacacatgataaccttctgttgtattgagctaatcaatgggtgtgtttatcttctttttactagtaccatggtttactgtgttttccaaaatactctttgtcattaattaaaacaaaccacattatggtaccatataatctattttctaaatgaaaacactctgtggttttgaaagttcgtttctggtccacaaacaaataatttcatgctcttatcctcatactatttgagtcttagtttttccatttatacaatggagaaagtaaaaatagaaatgcagttttttatttcagagagttattatgaggatcaaataagctggaggacatcaaagcaaatagtatatcatcttttcttttactttttattttttatttatacctaataattgtacattttgtggggcacatagtgatgttttgatgttttgatacatgtattgtatcagatcagggcaattagtattttcgtcatctcaaacatttgttatttctttctgttggaaactttaaatatcctccttctagctatttgaagctatatattatcattaagtacagtcatcctatagtgctatagaatgctagaactttttcctcttatgtagctgtaattgtgtattatttaacaaatctctccctatccctctgttccccttacccctcccagcctctagtatcatctgtattaagaaaatacggatatatggatgagaggacaacaggttatagattttgatagtgggatatcttaaagggaaggaactagttaattatccataaattccttcaatggtgtgaatattgccctttattatggcataattcttaaaatttatgctattgctttgagaagcacatcgaagagccatgccaaaccattctataactttcaggaccttggacagcttctttgcttcaagatagccaagaggttaaggcaaagacaacccaacagggcaaatttttttttctgaaaaagaaagtttgtttttaacccacactgtagcgttgtttatagcctcctcccagttcatccttgaatccatagtatatttctctatacatactcctggataagaagaaacaaataataggaagataaagttaggtattgtcatcagagcattaacacagtgatcttattttcgtaaactcttaatatcatatatatatatatttgcatctttcttttttctttcttttgtttttagagatagggtcttgctgtgttgcctaggtttgtctcaaactgctggcctcaagtgatcctcttgcctcagtctccaaaaacattgggattataggtatgagccaccatgcctggcccagcatcttatgttttgtagcatctagccataatgtatttttaaaaatttcctggccgggcgtggtggctcatgcctgtaatcccagcactttgggaggccgaggtgggcggatcacaaggtcaagagatcaagaccatcctggccaacatgatgaaaccccgtctctattaaaagtacaaaaattagctgggcgtagtggcgcacgcctgtagtcccagctacttgggaggctgaggcaggagaatcgcttgaacctgggaggcagaggttgcagtgagccgggattgtgccactgcactccagcctggcgacagggcgggactccgtctcaaaaaaaaaaaaaaaaaaaaaaaaatttcctgtctgtctgaattcaggaaccccaggtaactttgtgtcaatgttatctctgatttcctccacagagtctctatgggaaatattgtagaggttatggcttccaccctaacaataatataacataaaaggaaattctaaaatcttgctcatatctaatgggagcatttttgggaggcattgtgcacacattgctagagagctatgaaggaactgtttcaaatgaagagaaatgcaagcctaggcagtatgaaatgtatcttggtaacagccctctgtcctgtaatttatcccacctagttttctttttgtttagattgtcccacttaatttccttttgtttagattgttggtttttattttcagcaatgtcaaatgtaggtagtaatttgatttataataagagcttacatccaaatgttttgatagcagagtcaaaagaaatacaacctgagccatccccagggagtcatatacatacggactcacatgcatgcacaaacacacacaggagccacatttgcaactgcattacggatttacaaaattacttgtatttcattcaagaccgctctaatgggttttaccagatcagaagtgaaaattttaaataaattaatagacagtttaacccaggttatagtcagtcactcaggcaatcagtctagctttgtctgtgtattttacaaactggccacccaagttcagagtgaatataggaacaaaaaatcaagaagaccacaggtaaacataggccaaagggttaaccaaccagcccttactaaaaaagttagtcgtcatcattttgccccacttcctcatcgcctttcatggtgtttcacaaattttataggtaaatgagtaaggatgtgatctcattcacttatctattccgtttgaatataaaacattttgtttccttcccaaatctttaattgtatcttgataaagaattcaagcttctttgtactttgtaggagttggagatttttttttttttggttgatcatgaattattgaagttcagtggactggaattggaacacttggatcggagattttattctgccaattattacatgtgtaaatttgggcaagttagctaactttagaaacagtcgtcttgtcagttaatgagggtattattatatctgtaatgcctttcatcacacatggcttttgggggagtcagataataagagtaaaagtaacttataaactgaacaaataaaaaagacaatgatttaccaactacttccaacattactatttaaaccatgactttgagatgctatattttaagaatgaaaaagaaagtaatctttattttaaggagaggggcaaggcaataattttccataagagggcacagacactatatacaaaatggaatctgtctcagttttcagaattttcatttgctagctcgagtgcaagctgcttgtgttagtttgcgaggacttccatacaaaatatcatataataggtgctttaaataacggaaatttcttttctcacaattctggaggctagaagttcaagagcaagttgttggaagatgtagtttcttctgaggacctctggcttggcctgcagatggccaccttcttgctgtgtcctcacatgatcttttcttttgtgcacacacatctctggcatgtttttgtgtgtccatatttcttataaagacattagtctcattggattaggacccactctaaggacttcattttaagttaatcacctcttgctcttgctctaaatacagtcacattctgagttatggatggttggggcttcaatgtatgcatgaagggagcataaatccgtaacgtttgacttttggatctccaaaatccctgtccttctcatatgcaaaatacattcaccctaatcccaacagtccaaaatctttaccgatttcagcatcaattctaacttccaaaactcatgtaaatattatctaaatcaagtatgatgagagacttgaggtatgattcatcctgaagcagaatttcactccagctgtgaacttgtaaaattgtacaagttccgtatattgaaaatccattgctaagacaggaatgggatgaaaattctcattccaaaaggaataaatatgaaagaagaaaggaatcatagatccctagcaagtttcaaatgtaacagactaaattctattagatattaaggctcagtagtaatcctgtttggcttaatgccctgcgctccaggcccactggggtggtggctctgctttgtgggtccaccgggacagcaatgttgccttagccctgggaaatagcgtcgtcttctgatgccttgagtgacagtcctgtctctatcatcctgggaagtggcagcctggtccactgaagctaaggaggtgcccctcattctgaaatcaagaaagagacagccttggctttccatcctcccaccagacctgggcccatggtgagagtggcagtcccgccaatctctgaatagcttctggggtcattctttcatttccttgatgatggataacatatgtttacagccatttaacttgattaaatggatattgaattctcccatcctgtagaattctggtattccaatagcctttctttatttggggctatgtctgtcccctttagtccaagccgacagtgttttctgctgatataagcccatatttattcctggcttctgctgagataagtgattagatctatgagtcacatccataatttctttatggagtaattgtccagctacattcttggttttctttccaaaacataccttttattttttttcaataggaataagctgataattattcaaatattcaagttctggttgctttttgcttaacaatttcttcttcaataatctctttcctcttgcagtttactataagcagtaaggagaaactagactgtaccttcaacactttgctcagaaattatttcagctgaatacccaggtttgtcacctacaatttctactttccacaaaacactgggacacagttcagctaatctctctgccattttatggtaagtgttgtctttcctctagtgtcaaaaaatatatttctaattttcacctgaggccacaacagaagcaagcacatttaatgtccatgattttacagaaagtttgttcaaggcaatctaagcttcctctaatctgtgcctcaaacctctcacagcctctactcattacttctaaagctgcttccacatttttaggtgttcagttctttagcatcccacatcgtggtaccaaaatctgtattagttttctggggctgccataacaaaataccacagacaacaaaaatgtattttctcatggttaggagactagaaattcagtatcaagtttcagcaagcctgagcctctcttcttggcttgcagatggccatcttctgtctctgttcccacgtgatctttcctttgcacctgagcatccatggcagttcttttttgtctacaaaatttcttcttcttacaagaacaccggtaagtttggattagggcccaccctaagagcctcatttttacttaatcacctctttagaggacctgtctccaaatacagtcacattctgagattctgggagttagcgtttcaacatatgattttggaaagacagtttcgtaacttaacaataaatgaacaatttgagcttaacataatgatgaattttgacttaggaagaagcatagctttagcccatgtaacactgttgtatatcatcactgtgaaaggactggcatcttagtgattttaaaaccatgtttccctgagtctcgggcagtgagtcaggagggctatgtagactgtgtccatggttaggtggagatgctgatgggtttcggctctcagacctgttggacacagatgtaccataccaggggaaagtgctaaattgcttgtaaattcactggcactccaatactctatccatgtctggaaataaatgaacatagagtctgtgatcatattaactgaaccacacatttggctaggaatatcagatgataaaactgagtaattaaaataaaaattgttctaggatacctggaatgcacagcaattgctccttttcttaaatgttgatggccttacgcaatggtgttcacagcacacccctctttatcttggggatgctttctctgatggatgggcttcaaaattgctaatacacgaattactcatatttagacatttgttcttttaggtgccagactgttttcttttggaatgtatttttgtgtgatgcaatttgtcacctagatcttagcattaacttttaaaggatgaatgttgatatattggttctctttttttataatttcttgtatgacaaagtaattactacctactgtgttctaggcaccacactaagtgctattaatgtagccgtgaatttacgttgtcttcaccaagggtatcataatctaatttaaagtattttttcctcttgtagaaataccttcttccatgtataaaggcacctaaaatgttgtacagctcaattaagcttagtatctttcttgttttactcaatctcagtttataactgttgtagattaaataatggcccttcaaatatgtccacatcctgatccccaaaacttgtgaatgtttccttttaatgctaaaacaatttaaatatgtgattaaggatcttgatatcgggagattatcctggatcatcctggtgaactgctataatcacagttgtttttatgaaaataaataaagaaggttcaaagaagaagagaaggtggcaaggtgataatggaagcagagataggaatgagtcactttgaaaaaggtggaggaccccaagctaaggaatataggcagccactaaaaagcagggaaagagtctcccttcaaagtccccagaaagaatcaaccttgctggtaccatgacattaactcagagagaccatttttgaacttctgacctccagaattgcaagataataaaattttgttattttaagccactgaaggttgtggtactttgtcatagcagcaacaggaaactaatagaatcacattaataatcaccagtacactcaaaatcatttatctacattcttctttacaatctgctcccacatactattaccactgttattaatttatccatcttaattgtaatccttccttccgtatttgcatcatgctcttaatttagaaacttgacattccacttgaaatcttatggtcagtttccaaatggtatctctgttttcagcctcactccttccaaacttttctccagattgtttccaaaattttctcataaaagccaaatacgaacttttttcttcttaaaatcctgtgatacctcatgagcttctgtcctgtttgccaaactcctattcactcgtcaagaggcagtttaaatatcttcttttctgtgactctttccacagacataaatgtttgcattatcttctatgtttcaaaggcatcttgaatatattttcttgaaaaatccttttatatctatcgagacagatagatatagagatagatgcattccagggcagcctgttttattactatacatatacaaaaagactcaaaaggataagtaataaaatgtattaactgcaaattccttctggaggtaacattataaaatatgtgctaataacaggagaaaagaaacagtgaaaaaatacaaaacggtgttttcaaaatatgtttttcataaatagcaaaggctttagaggagatatgttacaatgcccagaaaacacaaaggaaacacagtatgcaaagatttacacatgtatgtagacatatcagggaagggaccagagaacaggaagataaatacaataatagttaacatccattgtgtgctttccatgagccaatactgttctaagggttttcatgttaattcactaaacaatccttcgagacaagtgttgttaataaccacttttaaagttgttatggagactgagcacaacattaatacaactaggaagggatttgaactcagaaagtctgtttccagagcttgttttcatatccaatatgctttaccatctcagctggaaggttttccactgctgctggatgggcttttctgaaagtgacctaggccaagccatgacggccaaagtggcccaagctcatcttcagagatgttcactggatggtggtgttcttatttttcaactccaaactcagcctgtaattctcaccaatttcaaatctgcaatcacttaagtctataatcgctatcaatgatatttctaacacatcccagcaattcttaaaaatgtctctccttattgtaagaactcctaattccacgagtgattattaatgcagggagagagatgagaagttacctttggggatataattgaaaagtgagtaggaagcaggcagaggaagatgaagtaatgacagagattgtgttgtgagtaacgcagatactttcaataggatatgcccaagttttaagtgtgtgaattttcaatgcttctctttatcctccattgtgtcatatagcatgaatcacccacatgagtgggtcatcaaatcaattttgtgggtcacaattagcctttgataaaggaaaataacatagaatggaacagaagagcataatatataccataacatagcgtaggtatatttgcataaatctgtatcagtcatttcacactttgcaaaaattactgcaacaagtggtaagtcacagtgccagagagccaattagtagagggagtacactgaagatgcccactgggtagaatggcttgttttgtctttttaaaattaacttcttatttgattttttggcctgggagaatcactttgatcatcactgtaaagaaagggcacagtttattttatattaacataattattagttaattgtgagatgaagccaggaattatttttctatcatgaataaaagtattgagattttcagtcaagtttcaggctgcaaaattaggctgtttttcagaaagaacattaccaaatttgtaactgtaacattctagtaaatttaatactagtacccttaaaattaactgatatattattaaaaagaaaaaattatgaatttaaaaatgtaaaggtatgttttagttcaactgaaggatttcaaaatgtaaatagtgaaaacattgagaaaaatattgacaaaggagcaacactgtcaatttcaggcaaaagtttaaaatgaaaaatttagtacaaatcatgaaacctaagacactcaaaatcattttaatcaaatatgaaaaatccagtgaaaatgacgcctgtgtttatgtaatgatattttgcaaataaaaccttaaaactttcaaaattaaaatgatacttggaaataaaggttattgtacttaccatgtcttttaattatttgtaaggaagggaaaatataaattcattggcacaatgtcttattcatttgaattttttattttattttaatttttttgaggcagtcttgctctgtcacccagacgagagcacagtggcatgatcattgccatcttgatctactgggctaaagtgatcctcctgcctcagccttctgactacaggtgcatgccaccattcccagctaattttattttattttataatttgtagagacaagtactcattacatttcccaggctgaacttgaactcctgaacttaagtaatcctcccaccttggcctcccaaagtgctgggattccacaacctttaatataaaatttctactattgcatagttacagcatcattgtgtgtttaaaaaaatagcacatataactttgaaaactatattaccctgtatagatgccatagtgtgtgtgtgtgcatttttttttttctgagagggagtcttgctctgctagctcttgttgcctaggctggagtgcagtgacgcgatctcggctcacagcaacctctgcctcccaggttcaagcaattctgcctcagcctcccaagtagttgggactacaggcgcacgccaccacacccggataatttttgtatttttagtagagacctggtttcgccttgttggccaggctggtctcgaactcctgacctcaggtgatccgcctgcttcagcctcccaaagttctgggatgacaggcgtgagccaccatgcctggcctatttttaagaacaaattatctgacagaaataaaacctttattttttgacacgatatcccattttgtaacttttagaaacaatgactgctatattgatacaatccagtataaataagcaaatcaacctgatgtgagaaatgacagtcaagagtgtgtaaaaatgctagctaatggcaaatggcaaaatggcttttggagggtatgtaatgtagttaaaatttgattaaatgttctttggaattggataagagcatcgttgatcaatatgaatgacactggtaaaatgatatatgagttacaattgagagagcaaaatatgtgactaggaaattatcagaagctactaataataagctctttgaagtcacttgttaaatttatcttagagctttgatatccaaagaaatttagctgccttttatggatggggaaagtaagtgaaaaatgtttgttttattaaaggaagctcactgaaatgtttttgatatatttcgtccagagattggtgctatgcatatccatattttctaccatcctagcattcttagattgtcatgaccaacaatactgagcaaaggtaagaatcaagatacaagattcactttttggttattgttggagaataatcttgtatagtaagtaatttctaagataatatttgggttaaaatggcagatttaataaactaggaaaacaaagaaaaaaccaaaatgcatttcaatatattgaccttatccaaaggtgatagtgtagtgttttgatatttaatttacagaaatgctctgaaataactattgccatcctgctttcttaagtaaatggtctagaggtcgtaggagttagcccagctccactaccatggagcaagttaatttgtagagataagatttgaactcagttcaaataaggctctgaaagctatgttaaggcctctcactgccctccctctgtaagtaagaaatgtgaggaaaccaagatttactcattaagcatgcccggctttgatatattttcccagattagaggaacagatggctcttagtggtggtttttgttgttttcatggttattgttattattattgctaatgcctacctattttccctatcaaatgaatcaggaagctttgtccagtccctcttaattaaatgcagtgagagaaatgggatatcaatccaatacattgagctcagcttgtcctgagagtcagggtgcctagagaatatttgatatgccatgagttgcacagtgttataatgggccctgagttagtgttttgtgtatagtattcgtggtagagtcctgtctcttcccagataagtgtgtgttatataggatataacagtaagtagacataagtgcttgtttttattattagaaggctgataaggagcagagaacttgtggtcttagcagcccacattaaggaatgcaggttctatttaagtgcaatgataaatcaatgatggatttccaaacccggatgtacttttttttttttttgaggaaaagaaaaacctttgttgatgcataaggaaaggctgggtagaagaacagagttaagggtgggaggccagttaggagactgttgaagtaacgcaagtgaggcattatagtggaatggactagggtggttagagcagaaatgaaattacactctctgtatattgcagaggtagaattaatcaaataggacatctgaatatattagatggggtgagggaaaatggactaatcaaagacaacccttatttctggctataggaataggatattgtcattaactacattgggagacttcgagtacggagagtttttttggattgtggaaaattaagggttctgttgggagatgcacattagaaaactaagtgaacttgctaagtatacagttggagattaaagcaaaagagttatcagtctatagatagttagagttagtgtgtagacatctagtataagatcacctaggaaaagatatagatggtgaagaaaagaggacccagtcgcataccttaaagtacattgacattaagaaactcgacagagaaagaagaaatagcaaagaaacgcaaaagtgactgtgatgcagagatagaatcaaggagagatttgaggtttacttactatattaaatgtggagaatttgaagatgaatctaaaaaatatttgtctgttttctccgagggaatatttttatggttcatttataaagtcatctgtattgttttatgtgacaaaactggtttcattggttctttagattacttactgtcatttttggatttgaggtcataggagcccagaggggcaaaactctcagtaggaagcatcagtcgtgtcaatactgctgtgaggctgagtagaaagatgagaagtgagaactttttcttttggtgaccaacaagttattgatggccttgagaaaaatgcgactctggagatgtgtctgcagaagctggactgtagttggtgaaaaaatggacaggaaatgaaaaaatggaaaaaaaatctgtccagaaggttgactatgaagaggagcagagaaatgaagtataaattaggagaaggctaattgttcagggggcaaattttttacagtaggaatattatagatcatgtatgaaacttaagggactgatgctggagaaagtttgaagaggcaaaatatgcaaagaggaatgtttggatggtccttgagaaggtgtttgcgacagagtttgtagtctaagaagtgattgtccgtatctttactctttagatctcaatgttctcatctgtaaaacggtggagtagctgtggattatttccaagcttctttgtgacttgaatattctacaaatttattactgttagtcatgcatatgctagtaagcagtgatgaacatgggagatgtatcctgaggctgtttactctcatattaaaagtggagaatttgaagataaatctaaaagatacttaagtctattttctccaagggaatatttttatggttcatttatgaagtcatctgtattttatgtgagaaaactggtttcattgttctttagattacttatcctcttgtagaaactgtaactattttgaagtttgaggctgcaacatattcacattggtttcactgttttaatcttattttcactgcttttgccatctaaccataagatattggtgcagtaaggataattaagtaagataagtttattaacagcagcaagtatcttgaagacatacccatttcagatgtatgttaatgaccatattttttactctactatgctggaaggttttcgatggaattcccggaaaagagacttatagcagccatataaataacaattacagagagtattattggtatttatgctgaaatgccttttatattgtctttaatacttgagtagaacttaattgaattatatttgtcaaggtaactttttcctcttaagaaaaatcccgttgcttaaaattaaaaaaaataaacctagtattttctacctactagtaaaatgcaagtttacatattaaactcttgctttgcaaatgttaaattggttgaaatgagtcaaattggcaatttgtttgtaactagaatgtgtgtgagaagctgagtcaaaaatttgagaagcctccattgcccttttcaacttacatggtacttatttatgcaaaaggaaggcacatcaggtatgtcgtgacatgggctgaaacctatgtccatagaaccaggaagagttgggcatgggatatagctggttgatggaaactttcaagctgatatttcagtgttaattattgtcttcaatatgtacattgtttccaagaatcatattttgctttatcaaatggatgcattattatattttgttaatatctctgatccttttttgttcagaaaatggttattatctcaaaaatcataggatttgagaaagattacatgatataacaagtataaattgtagatcatagaacttggcacctagtaagcactctgcctcagcactcatgctcaaagtctgttaatgagatctgaatctggtggttttacagggtacaaaaccacaatgatttgtgaatatgtgagtctatggtagaatattaatgtggaaataatctggagtgcatacactgtgtgggtcccccaaaggcatgggtgattgtaggcataattaaccaaccttccttactcagaaagtggaaatggcaagttagagttttctaaaatataaaagcctatttaccagttctgtgatgagattttttttaaaaatccacacaaaaacaaaacaaaatgaaaaccacacatgatttagcttgtttggattgctatttgatgatatttaataataatagaaataattacctctgaacaaagttaattcagtatacattttgctattacttttctcttaagtaaaataatatctatcacccatgaatattttaaagaggtagctctttattctccagagtaaactatgtaaattcccaagaaccaataatttccataattattaaacaaatattatatcatagtttctgagcattagtcacagaaaaactcctgagattagattgagacaaagtgtcatgctttacgtttttactttacttggctaggattctcttattagaaacatacctattgtattattattttcaagcaaagaaaacaaaattccattgtaagttgggtcctttcacacttaatataagcaaaaactgtcattttttcattactgtaagctgattgaaaattgaaactgtgaacaatgtagctgttccaaataatagtttaaaaaataaaattatttttttctttgaatatatattttatttatcagaactcactaaaggattatatgtggaaagaatgttggtttataatttagaaacaacattttttagagatatttgcatttgcaacataatggaagttgatctcatagttgtaattgtcaataactgtctgctgtgcttgagactatatctgcccttgctcatttctcactctgcactcctggggaagtggaagaacattggccatgtctccttttgctgggcataagaaacatatataaatagatacgttataaatagatagtttcaagtaaataatgtgttctcttaagctcacaatgatgacttttataataaataatttctaccataacaaatgatttctttgcattattgcaaatacagatttcagcaataactgttttaggttccttttctaacactgtggatgagctagaatgactctctttgtcctctccttcagaggtctctcctgtcacctcctctttttctgtcttcccatttagcttaggggtctccattctataggctctctcacaccattgtcacagctgcactgtgatccaatatagacattctctgtatgatagcaactcctattgagtgccagcagatacaagtcctgcaagatgcccaaagaataaaagagatctatggtcaatagtgtagccatcttacagggtcaggattccattcatatattaaagtctttgtgagacttgcagtaatgaaacctgtgattaatctatacttccctaaattactttatcatgtgttttagaatagatatttctagtctgagaacctagttatattggaatagtttgggaaatgtcatgttactatttgaacgataagaagttatctcttcatttagaagaggtaacctagactaagaatgattgatatcacccatcagatttcatctgcttaatttttcagttctgtgcatttaacaatagaaagtttaaaacgagccatccttcaatgtgtttagcattataataaaagaacataggaaagatatagtctactgttctcattttacagttgttgaaactaaagcctagagagaggatattagttgaccatgagcacacagcttagtttaaagtagctgagatgtgagttgttttttgttttattttctttttgagacagggtcttgctctctcacccaggctggagtgcagaggtgtgatcatagctcactgtaacctcaaactcctgggttcaaatgatcctcctgccttagcctcctgagtaggtgggcctacagatgcatgccaccacaaccagctaatttaatttttttttgtagagatggggtcttgttaggttgctcagcttggccttgaactcctggcctcaactgatcctcccaccatgtcctcacaaagaggtggaattacaggcataaaccatgcacccagtcaagattgtgatccaaattcttattttccaattccaaatttagtgtcaagtctacaagttcaaactactttcattaaaagagaaccatagttacaataatcttgatagaacccacagctttttgtaaatggttttatttgtagtaatatttttctgtttgtaatatgtttctcgtgaatcacatagaagcgcagaagcattgagaaagcccatgaagctgggtttttgtacatttgtgcatatagcagattgaacccctcttttgctatttaatatagtgtgaagatttccccagtgctgtacttactttccaaaaacatgattgtttctttagacaatttcctattgttgtttccaaagttttgctatttaaaactgtattttaccaaacgtacgaaaaatgtaattgctgggtcaaagaataacaccatttctagggtttttctctgtaatgacaaattacactctaaagtgttatcagtttcattcctctcagtagtgtatgagaagacacttgtttattttttacaatcaaacatagtatcttcaaattgtccagaattctgagattactttctttactgttgactatgtaaaatagtaacttaaaatgctttttatgcctcttggatttctccctaatgtccctatttctgttgataataatgaagttttctatttatgatttaaattgccattattatatataaaacatctgtttgaaagtttaaataagatattgtgttaagctgaaaggtaatatttaaaaaaatcattgagcatttaccgtatttaacaaggttcccagtttatcctctcttcttttaaacctgactttctagtacttgagattttctttattctttcctggttaggttaagtatgcctttaactgcttttttttttccttgcataaaggatagatagcatgtcgaatagttggaaagaatttgtatatgagataatagctttctattgctcctatacattgtcaagtgatcaagaatatgctgggtgctcattcttggttcgtagttttctttttctcaaaagagtggagtattttcattttcattattttttggtgtctgattatatagaagtcaaatttgaagcaagtccaatttgatcaagttcttttaacttaatttttggatacttgtagaattttttaaatcttgaaaaattattgccattattttaataggatttactttttgtttcttcataaatctatttttatggtagctcttgagttctaaaacgtcagttttctttagctgaggaaagttatttttcatttttttctatggtaactgcacttgttccattttgctgtctttttcagatttctttcttatgtgaatttggtctctcagatatgtttttcgtatctcccactcacaacattttgtcttgatcctgctgaatggagctcaagatgaattcctgcagttttctctttcatttggctttgctaataatttaacttagtgtttttgatttaacccttggtgttttccatccaatgcaagcatttcatcttcatgtttacgtttcatatttcatagaagcaatatgattatatgatgaatgccaataaatatttagttattatagtatacaagagataaaggaaggtaacaccaaaatgtttttcctacaattgtttcaaaaatctattttcttgactgtccctgctttcctgcacttcttctcgtaggttcactgattttcctgtttgctcacttggtttcatgcatgttgtggccggaatgcatgtttactatggaatgcatctctccactgtgtttggcagcaactcgaaaccccttcatttagcttttatgctggctgtggctgtctattctgagggaagacttaaggggaagccctgaaactatcttttctgcttcttgtgattacttactgatggaaaaggctcccttgatttaacttgtgttggctgttcctggtactggcctttgccttacagtttaaggatgctgttgaatattaacatattctttcaattacttcctatgagtgtctggagataggaagtagttgaatgttggggtgaatgatagaccacccacttctgcagggttccttgtgggtcttcaatattctagtcctacagaattccttgtactttctggttcttcatcagtaccttttctagatacagaccttgatattgtttgttttgttttgttttgtttgtttgttttgttttttgttaaattggtcaatgccatgcaactgtggtcagagggactgaaattgttttcacatggctctcttcactggaaagccctgggttaatctgctcatgatcctttacatccagctctggaatttttttttctttataatgcataatgaatagctttgctaaagaggattctgctttcaaatttcaagaataaaaagaggacatctgtctgagtattaacatgatggaaatttttaaaaatatcacatagtgtgttagctcatatgtgacaaatagataatgcatctcatggccattaggaacagaatatttgtcagaacattctgtctattgtttaaaggcattggtgtaatgtcataatatttctacaaggtatgaaaatgttgcactgtgcatgtctgaagtctatagtgtatcccttagactcttgccatttagctgaattctgggggaatgttgccagtatcgttgtttcaaatgagataatcaaatggcttatggagctctatttacccccattccaccctctgtcacaatatagtaagttacttattggagcatatgcttaatgaaaaattaatagcaatgcaatatgatataatggtgcaggactatattctgactagtataagatatttacatatttttgccaattggtcattatcttttatttcacatatccatgatgagtgcatatttagaaaatgagagagtgctttctgctaatgtttctgattattagtgatagtgctgaattcatatgcttacagagagactgagagggagaagaagaggggctagaggaaggaggaggcaggagagaaaagaaagggagagagaaaggagggagaggaggaataagagtgagaatgtgaattgctgtgtgggtgggcctgtgtatatgcaacacagatgcataattttggaagtctgcattttctatatcatcattttggaaccttaccaagtagtgcaaatgctgtgatttagttgaaactaattatgggtacctctaaaatggtatctcacataaatgtctcataggcatgatttgaaaaaaaaataatttgttattattcttccttgaaagtcatgtatttaaattctttaataaaatgggtaaggtttctgtgactagccaagataaggctgcttacacttatgaatctataagagactatacatttcctcactcttgcatgctattaccagatgaatcattctattttgtatctggcgactcattcatctgctaagagaccttctgggccccacagtgcctgcagtgcacatggaagctctttaggctgacattcagggtctcctgtgatatggtgcctctctaacactgtatcgcagttgacagtttgtgtgtgctttggcctccagctaagtcaagccccttgccattctgagttatgactgtgggatttctgccctccgtgcctgtgcagggtcactatgggatgtccttcgcctccagccttctatgtctagatgctgtgcatctttacacactcagctcagatgccttctcctccaggaatggtcaccgctgaggcatcatagttgttctccttttaacatgtaaactgatggaagcctttaccttcatgtctcctaagacagtgaaatgtgaagcctcagctatgtatttggagggccccgaattccaattagcccagttatgttgtctttggtatgacacctaatatctcggaggctccgtttcttcatctgtgaaataggggtgataatatgcatgtcacagggcttgggaaaatgaagatgatgtctgagtcatgtgtagcacagtgcttggaccataatcaatgtcagataagcgcagcatactctatgatttttattaagtgccattgctctctcctataatgtgatttatttgtacgtaatgtctccctagctgtggggtccctcatatttgtctatatgtctgccccccaccccccaccaaaggcccaacttttttttttttttacctcaaatatgcacaaaattgagtctttattttagtactcagaagacagtgtaattccagcccagtttcttccattatttccagtacctctgagctgagcaggtctgggtgatttgtgagtcttcatgtgtgataatgtgtagcctctacttcaactgtcttctaggtggcaagaacttctggcttccttccctgaagagaccagctgaagtttgaagctccgcactctcaaagagcttgacagttgcaaggatattttcagtgtgataaagggcgtagtttccattggctgattttaagaagtaatacacatggaatgtgattaaacttgtgtcttctgcttatcaaacaggtggacttttaagctaatctagagagttgagctggttagcatttatctacatttaatcagatctaatgttggatagttctacttagacatgtttctctatatgactctagacattccctcctgtggctagaaatcaacctctttataatcctgcctcccaaactggccactctgattctaggaactttgtggtatgctgttgtcttcatgtcctcaattctccacactgctgtgtagtgtggaccagtggacatctcatgggtctttggagtcagacaaactgggccgcagagtcgatgttgatattactgaacacttctcagtcacaatgtcctcatctgggtaaataaggctaatattgtctactgctaggactgttgtaaaggaataaatgatgcacaagtgttatgtgataaaacaacgtgtgtgatagatagaggacccaatgaatgttaatcatctcctctatgctttctctccttttctcacaactaaacatcatgagaaataagtctagccaaaaggataagcatatatcttaagtagggcttcccttttacctgtaaacatcctcactttttaaaaaacatagcatgaaaactttgtgtgtgtgtgtctgttgcccaggctggagtgcagtggtttgatcttggctcactgcaaccttcgcctcccaggttccactgattctcctgtctcagcctctcaagtagctgggattacaggcgcccactgatttttgtattttaatagagatggggtttcaccgtgttggtcaggttgatctcaagctcctggcctcaagtgatctgcctgcctcagcctcccaaaatgttgggtttataggcgtgagccacggtgcctgggcggcaaagtgtttttaaagagaaatacctttttagattccaaaaatatttactacttgaatgattattgacagtaaacagccatcatttacgtgaaaggtaaaacatgtgctttattttattttttaaaacatgttcttacgagacctcaaggctcaactgacacttttttaaaagagacagtagaaattgaagaaaacgataaaatttaagaagaacgatttctaaaacttatcccaaaatcattgaaagaagtacgttggtgttttcaactaagttattttgaagaattgagatcattctagacaatcacagtcttggccacatgagcagttaaaattaatacaacatggctatgataatgacattttattatattaattacagtgaaaatgtattgttcaagaaaatattttctctaggagaggtcaggtcattttgtaaaaaatgttcaagtttgtaatgagactacataacttcttatgtttgtttctttgggagtcgtaacaaaaccttaagaaatgagatcttcattacaaatagattcatatgtgctcataagaaatcaatttcctttatgcctttaacaactagcagatgagaataaaatggaataaaactatggttatgctttaaagtactggcaatagttttaacaaatgagacttcatttacgtcttcaatatatgtatattgttaatttattatctctaagtaacacagaaattcatgtgagtccagtgtagtgggagctgagacacagggagtataaactgaatccagacacttgcttcagtcaagtatttttagatagttgccttagtcacatgatccttgtctggacagtattaacttcctttgctgatatctattctaaatgatacattttgggaacataatcatgcctaacccagcagtgaaaccctatccaaacatatcagtttgaaaattggtaaggaagatgctggataataaaatgtagatatattttagttcctaatgagctaagttatgtttctggttgtgttttacaaattattcataattaccctttgggaattagtttacctaaactttaaagaacacacatttccaattatcaataaaatttaagtagcatagaaaaagattgtatatacatttttgaattgatccttccagaaatcttatgaagtagccgttcttatgtccatttggacagaaaacaattatggtatttagggaaactaagtaatgtatcaaggtcatgtatacagctgcttttttttttccttcttggccacataatgtcattttggagttgtgagccatggggtaacattgtcaggtttgtagcgtagattaatttttctggcagaaatgtgaatggtcaatttgtgagatccaagactggaagcagggtcatgtatcacccttagctcctatctttccatcatagcccatgtcccacacatcaggaaagctgttagctataatttgaacatgtatcaacaagtcaacttacttatgtaaggccactgcctgtatcttcctggcttcagcctgtcaactccttccttcatatacagtagcctcctaatttattcacaaaatgctccaaaatgaatatattaacttactaaccttacgactgtagcaaatactaacagttgagtaggaaatttacttaataggcagcttgaaagaaaattcaagtcaatgcagtacatttctgctgcaaatcatttctgttgcaaaattactccatttgattcttgtttttcagtggtcttgccagaacaaagttgctattctgggtttgttttttctcttttaaaataattttattcaatttatgaatttgtttcagtttttaatagaataccctgacaaacattgtatggaaattccaaactaaaactaaacaaacattgccgtgttttcaactgtttcttttttatactgctctgaagaagaaaacaattctccctgaacaaattcctattacaatgaaggcaaagatcatgttttaaaaatatttactgccactatttgaagaaaacttctaggattgttgttcgggctcatacatttttaaaaaaggaaagtgtaagagaaaaaaaaaaaaaaagcaaaggaaaggctggtcatggtggctcacgcctgcaatcccagcactttgggaggccaagatgggcagatcgctcgaggtcaggagtttgagaccagcctggccaacatggtgaaattccatctctactgaaaatataaaaattagctgggttttgtggtgggcatccataatccccgctacttgggaggctgaggcaggagaattgcttaaactcaggaggcagaggctgcagtgagctgagattgtgccattgcactccagcctgggcgacacagtgagactccatctgaggaaaaaaaagaaaaagaaaaaaggggaaacgaggaaagaaggaaaaagaagagaggaatgaatgaaaatggaaaatagaggacagggaaaaataaatgaaagcttaccttactacgcaagtgccctattttctacacataggaaagctaatgaattgttagtcttgttttttaaacttggaaaacttaagtcactttttttgtactgatattttcctgatttcaaaaaaagttacccaaattaagaagctaagaggaaaatgtatttccagttaactgaaatattaagttgagcaatcatttcatataggatctgcgttcatgtaagtgcatgtaaatgctctcagggtagatgtatgtttgggacctaataaagtttcctcctctggttttagaaacaggttaggatcacaaaatcatgatacaactaacaacttcaacaatcatcctcctttgtttggagcccattgcaaaacctcttcataaaattgaacccatacatatagtatgatgcttgcaaatctgaaaaatccctttttggacaaactaactcatcttgcaaaacttcctacctggagtttcctctcagtaatccttaacaggaccaaacatccctaattgtataaactaaagaaaattaagactagcaagacttcacattgaccccagaattatttctaaagttgccaaatacgtttttgtctttgtgtctgtagcaaatctcttactcttgggacctcattacctgagtcccaggacacctcaaacttctctgaaaagccaaattgccttaccatgggcctgtcgagaattcctgtccctcttcaatatttgtcttacctttgattcctgttttattcaactttaatgaatcctactgtctcttcatggacccactatccacacctgtggagtctgggaacgttcaatgtggtagaaaaatgtaaaatttttatttatataaaaacagaagacttgtaattcagcagctgtgcagtgtttttctagcaactgtgtgctcttttgcatttggtacagtataaacttctagtttgttctgctgtcatggaacatggtcccagtaaaccttcctgaggtcagcaacttggaccttctgctgtctaggtcccatgcttggcgtagtgtggataataatgttaaatattatatggttttggcttcactgagccatatcagaacattcacaaatagctgtcatacaaattcctgcttcttattgccccttttccactgtgcatagatgcaagaaaatagtttcatggccaggtgctctttgtttcagcttcctttgtttctcccaaggctgcatggcaaatgtatgatttgttcattcttttaaaaaaaattgagtgctaagtgccaggcattatgaatgtatgtatgcttggaagagggggagagcagtgttattatctaactcacattttgaaaagatcactctgattgctttgtagaaaatggtaaggggtgttgaggaggggtgctgatgtgtctggacaagtaaaaacattccctagttgtgattagttcaaaaggaagcttaatagtctaagaaataaatgtaaggtattagtttgaaaaaaggtcatgctgattaattgcatgtgcaaggggaggggaaaagagaggggagatttcttgatttatgggtaggtggccttgtgtttagttaggaacactgggagaggaatggctcatgggcagaatcatgagtttggaaatattatgtttgaggctcatttaagatacacaattggagatgtcaaacaggcaactgaatatatttaatatgagccttgatctggataattctttagaggagttaaacattggggtttttatagaatataaattgtatttaacctagtttttgaaagcatctaggatagaatacagattaggaagaggatgggttccaggactgagcccagagattcctcaggtaaagtaaagaaagagaaggtaggactaagagactgaggagtgaaccgtgaggttgctggaaaaccaggagactgtactgtttcagaagccaatagattcatgcattttaagaatgacagagtggccagttacattgaaggctgtttaaagtcgagaaggatgcttggaatgtgtccattagatttggcaacatggaaattgctggtaaccaaaatgccagagaaggtttatcagagtggctgctgctgttgaagccaaagtgggagtgatctgagttgctgatgggagtgtctgttgacctatcttttgagaagtttggctaagggcagcagagaaatagcatggttgatggaggggctacggggtaaaggaagttgctgtgccttaaaaatgacaccttagagctgggtgtgttggcatgcacctgcagcctcagctactccggaggctgaagtgggaggatcgcttgagcccaggagttcaagtccagcctgggtgctgtaaggatacctgactgaaaacacacacacacacacacacacacacacacacacacacacacacacagataccttagagcagcatttattaaaccgcagtttgtgaaccataagtggtcttaaaatatttttattgggttgcaataatcatttaaaacattaattggagtaaaagagaaaatagggtacatgccatgtggtaaaggtaagaattttatttttgtggactatattattatgaagaatttacaaatagttacatatctacacacatatactggtgtatattggattgtaatataaaatgtatttcttcacgtgaattacggttttaaaatttgaaggccatcaaactagggaatgtttgcatgctgatagggataatctagtagagagaaagaaactgatgacacaagagagtgggaaaaccaaaggtgtaaagtccttgagcagagtgaagaacttttcacacaatcttctctcttttctcatttatttaccatgtggcttccaggtagtcatcatcaatctaaccgtaactgaacaaatcccatgtttctgcaggtatgtgcggcagtgctgatgtttttgtcaacagcaatgatttgacatcagcactgggctttggtttaaattgtttcctctctcctttttctaaatgtgtatgttaaagttctaaccaccagtacctcgaagtatgactatatttggagataatgtctttaaagaggtaattatattaaaatgaggacgttaaggtgggccctaatccagtatgatcagagcctgtatgagaagtctggacacaggcaggcacagaagaaagaccatgggaagacgctgggagatgatggacgtctgtgagccaaggagtcttcagaagaaactggctctgcttacaacttgatcttggacttctagcctccaacattgttgagaaaatgaattgcagttgtttaagccactaagtctgtggtgttttcttacggcagccctagcaaatgagtacatactgtcatgcttgttatttgatttggcctttgattgttacaacagcctgaggtgtggaggaccagaattataaatgccagtttacagatgagaacactgagatgaagagataaatgactgaccgaaggtcagggatcaaaatagctagtaagtgatacacaaagtgttgtagatcttttccaagtgttgtttccttggcaaaagccttggtggcaggccctgtagtcatggcctgcctgtagtggtagatatgactctatgctggtccattaattagtgccaaaagctacatttctctgcaaatatagattctagtgtgttctgaaataagacttacaacacttaaaaacttaaggatgcctagtgatgaaatatattaacattttttaaccatcacttttatgtagcccatgaaattatacagctcaataaacatttgaaagtttagtctctcaatgagaagtgataaaatttgacccgtgcatgaaaagaagacagctgattctttaaagcctttttgaagagctatgacatttctgtaaacatgcaccaaggaatatctgaataaagcaataatcgatcaactaacattgtgttggtttcctgatacaaacacctgaagtgaatgataccagtaaagttaccatccttttttctgcaatgctttttaggtcattttaattttaagctacatgctcttaacttgaattttaaacttcttaatggaatgtacttacaatgaataaatgctctgagtgacacttagagtttgcaacacgtttagcatgttgtgctgattcactaacgtacgctttctttcagattacttttactaagtaaaagtagtctacccttacactggtgaataagacaatatttcaaaaaattcctaaggtaacatagaggaaatgtgtattttgtgtgtgtgtgtgtgtgtgtgtgtgaatcacctttcagtataatgagaaattttatttcaccttatgaaaacacatgagtttttttagcatacaaacttaaagatcaaatttttaggttgtacgttgtgtctgtcttcagctgtgtaatgctaaatagatcttcaggttaccatcttatctattatgcatttgattctgttttcccacattctaaaatcagtcagattattgatttttacaatctaaagaggataatatgttagctgattattttcataatttgtgatttcctgattattagtgagattattagtgagacaaagagatctttgacatatttattggccatttgagtgtcttatgtcaactgtctattcatataactagcctgtttttctatttatttttattttcttacaattgaatttatccgttccttttgcatgttgtatgatactccattttacctgtgagatttgtaactatcttcttccaacctgtggctttctttttactttgcttataatgtattttatcttataaaaggtttcagtattaatatgttcaaatatgtttatttttcttttatgcttttttcttttctgtttctatctttatatcatcaatatagtctctacgtaataatttgaaagttaaatatttgtttacctgatttaagttattaatcccatcagaagttactttttttgtttttgtttgtagataaggagttatctgattttttttctttctctgtatggttagccggttatttctgcaccatgtattggatagtctatcttttgctcagacatttgtcataggctgtatcctaagctctcattggtacctgagtttattttaaggtcatttattctgtcacttttgttcctgtgtctattccttaaactatatacactgtttaatttctgaagctttttagtaaaggcttatatcaattaagctaagttctctattcattcacagcaaaatttccttgacagatactgatctgtaacttttccatgtatattttagcaaaaaattgccatcttccttgaaaacactaataggatttggttagaattgctttgattttatatatttatttgtaagaattgccttaaggacatttgggcatatgagcatgatatatagctcgtttgcttatgtctttttatggcattcaatagaattattattttaatctaaaagtcttacctacatgtttactattaatagatttagttataactgtcattgtgctattataaaagtaactctttaaaatcaaattttcttttttcttttcttttttttttttttttgagacagagtcttgcactgtcgcccaggttggagtgcagtggtgtgatcttggctcactgcaacctccacctcccaggttcaggtgattctcctgcctcagcctcccaagtagctgggactacaggcgcacgccaccatgcccagctaatttttatatttttagtagagacggggtttcacaatgttggccagatggtttcgatctcttgactttgtgatctgcatgcctcggcctcccaaagtgctgggattacaggcgtgagccatcagtgcccggcctaaaatcaaattttctaacagtttgctgcagatgtgaaggaatattacatggatatatttagtatatagaaatcttgctgaataattttatccattataatcatttatttattgattttcttagattatgtgggtaaatgtggataaattatataattcttaattcttttaatccttctacattttatttttgtgctattttactgtagtagatattttcaatacaatgaagactagaagttttaaaaccaggatagcaacctcatgggcctatttatgaaacaatacctatttatatgctacaactttttcacctgttatcgtgaatgacaattgacatctaacaatgggaaccataaacactgttgagctctaaatgctttcccagtgcattaaaaaaattaaattgactttctttttcattctttttctctacctctctcagaaacaacttctattatttactcattattatcttattccctaatttttttattttattcaacagatacttactgattgctcaccaatttgccaggcacagctggttttggggggcattccatgatgaataaaagtagcaagatcccatttctcatgaggcttctggattaacaagggagacatgcattatatagaaaattacataatggttatttccttacaatccgatggttactctgaagcacaagtgtagcatgctgtcagagtgcttagaagatcgggagggaatagtgctaatacatagtttggaaggtcagggaaagacatctgaacttgaccacactattgagtatgagttcgacaggcaaagatgggaccttgagcatgtagaatactccagtgacaagagtagatgtaaacaaaatagctctaaaaatagtgttcagtgaaaagtgatttgctataaatattacataggtgtgctaaatagaaaaatagaaaaatgattgaggacagcaaatatctgttgaatgtccctatttggaaggtatttaatatatcactctgaattgttctctggttaattaggaaaagtaagtttaaccaaggggagggcaatggatgttggtacagagctattcaagatcatggctacctgtgtacttgcctcatgcaagacctgtcacccattggaacttccatcattttttctctggatccatttctggtagtctctttattttgatctctatttttccttggtacccatgaggaacacaatttgaataaaagaaaaaaatgtattcataatttagaaaatgattttattggacccactaacatcaccaggaagaatgcaatgcaatattggcggtgggcattttggttaagactgggttggtcattttaatacaccctttcagccagtattcagagcaaggcatgtgcttgcctagacttcacattttagaaaagccagggcctatatatggagagttcttttttgtcagtctcatgaaatgaagtgctgcagtttgcatttttcctattcagtttcaagtatgaacttgattttaaaatttaactacagtttcgttaagatgtactacaactcccagctaattatgtagatgtatcaaatatgtattttatttaaaagccgtattactattttgcttttatccatcaatgattcttggataaaaggtggtaataaaatgttaatgtgtatttagtcatatgcaaaaaagtactatagaaatttctgaggtgtacaatgacatgcattattgcttccataagcgtaagaaaactcagaatgacaagtctacacaagctaggtttcttgttcatccaggggtggcttgctttgtaaccttttcctgaatagtagactaggtactgtcttccttttatttcccctataaattagttgcagtgttcttggggtccttagggacttcaggtggttgagcctttcaccaagcatacatacctagtctgtgaacagaagtctaggactctggaaagcactgagggcagagatgcttccagtcctgtccttacacgacttcccctgccaacctcctctcttccctcaggtatttttcttagtgcgttaaagatatttccttttacactaaaggaagtccagtgaaggttgcacagtgtgcagtggtgcacaaaaacaaaaacacaaaaaagggatgcatgcactctcaatagaattttacatggaaattgggagaagaggactccatctttctaggggacaataatggacactggccaaaagcagctgagtgagagctgagaccaaatccctgggatcagacctttcagccccagccatgcctcctttgggcatttgccttgtggaagactgacagctcctcagtcagtatagagggccagagacacagcgcagtatagaagcacatgtattatgacctggtcatgccaccaatatgtgagctgtgcttttctttgacatttttcattactcagtgaaagaagtagaagccatgcttgtcttttctctgccctggagaagtggagataacaagggctcagcctcatgagatctgagatgtagggcagactgtgtccacaatgcagaacttcagtgaataattaaaaatgagggcactttctaatggtctaattgagcacacggtgaaggaatttccaataagttatgtttaaccatcaagtgacattataagaagaaagaatttcatctttattttataggtgagaaagctgagccttggagtgggtaagccattggccaaggtcataaacaagtgtgtccaattccaaacctaagctcataatgagtacactgtgctgttgtaaaaggggccgtctctccctctttcagtcttaatgggagaaatatttaaaggcatctttgtgagaaagttttctgcaaaatataatgtggtttgaaaaatatgagttactgtgttaggttcagattgttaagactttcttttaatgtagaaggtgtagtgtctataaccattaatttgtgttgcaccctcccttttgtgaagcttattaataaaacagtctgctactccatcctccaattcctgtacttccagtgttcaagtctgctgatcatctactgcctaaaaagttttcccataaacaggaaaggttccagaagtgactttatcaacaaaaacgctgcttcttgctgctacaatttcctgaattacaaggcacagatggacattaattggagcgggtgttttgagagccagcactacctgcctcacactgctgagggatatagaggtctctattcctttctaagcacaggactcaggaagtattctggaagcagctcagaaactcagggtcctgcagggatgtgcctcttttggaagggcaagaaacctcactgatgaacagaagcccctcaacttcagattgcaacctcttcttgtgacacatgagacgcttcttaagatttcaaaacaaaacttggtttccagagggcagctagtgagctcatcctgtttggagacccaggctgtgtcttatctgtgtcaaataggtaatattttgacagaagtgtttccaactagcccacctcatacatagaatattgtactgcattggtctgttgtcatgctgctaatatagacatacctgagactgggttatttataaaggaaagagttttaatggactcacagttccacatagctggggaggcctcacaatcatggtggaatgaaaggagaagcaagccacgtcttaaatgataacaggcaagagagcttgtttaggggaacttccatttatagaagcatcacatctcatgagacttattcactattacaagaacagtatgaggacacccacgcagcgattaagttatctccatctggccccacccttgacaaatgggattattacaattcaaggtgatatttgggtggggacacagagccaaccatatcattccacccccggcccctctcaaatctcatgtcctcacatttgaaaacacaatcatgcccttccaacagtctcccaaagtcttaacttattccagccttaatccaaaagtccaacagtccaaagtctcatttgagacaaggtaagtcccttccacctatgagcctgtaaaatcaaaagcaagttagttacttcctagaaacaatggtggtgcaggcattgagtaaatgcccccattccaaatgggagaaattggccaaaacatagagactacagtccccatgcaagtctgaaatccagcggggtagtcaaattttagagctccaaaatgatctcctttgactccatgtctcacatccaagtcatgctgacggaagagatgggttgccgtggtcttgggcgtctccacccctgtggctttgcagcatttatccacctttccagctgctttcagaggctggtgttgagtgtctgtgtcttttccagatgcacagtgcaagctgtcggtggatctatccttctgggttctggaggatggtggccctattctcatggctccactaggcaatgccccagtggggactctgtgtgggggctccaactccacatttcacttcccacactgccctagcagaggttctccgtgagggcctcgcccctgcagcaaacttctgcctggatatccaggtatttccatacatcttctgaaatctaggtggaggttcccaaacctcagttctttacttctgtgtacccacatgctcaacatcacgtggaagctgccatggcttgggatttgcaccctctgaagccatggcctgagttgtaccttggccccttttagccatggctggagtggctgggatgcaggacaccaagtccctaggctacaaagagcagggggaccctggtcccagcccatgaaaccattttttctgcctagggctctaggcctatgaagggaggagctgctgtgaagacctctgacatgccatggagacattttacccattgtcttgacaattaacatttggctcctcattatttatgcagatttctcagctggcttgaatttctcctcagaaaatgggtttttcttttctatcacattgtcaggcagcaaattttccaaatttttatgctctacttcccttttaaacataagttccaactccaaaccatatctttgtgaatacataaaactgaatgcatttgacagcactgaagtcacctcttgaatgctttcctgcttagaaatttcttccaccagataccctaaattatatctttcaagttcaaagttccagagatctctagggcaggggcaaaatgtgaccagtctgtttgttaaagcataaaaagagtcacctttgctccaattaccaaaaagtttcttatcttcatctgagaccacctcaacttaagcttcattgtccataccactgtcagcattttggtcaaaactattcaacaaatctctaggaagttttaaaccttcccacatttttctgtcttcttctgagccaactaaactgttccaaactctgcctgttacccagttccaatgtcacttccacatttttgggtatctttatagctgcaccccactctaccagtaccaatttaatgtattagtttgttctcatgctactaataaagacttaaccaagactgggtaatttataaaggaaattggtttaatggactcacagttcctcatggcttgggaggcctcacaagcatggcagaaggcaaggaggagcaatcacatcttacatggcaacaggcaagagagcttgtgcaggggaactctcatttataaaaccatcagattttgtgagatttattgactatcaggagaacagtatgggggaaaccactcccatgattcaattatctccacctcgccttgcccttgacacatggggattattacaattcaaagtgagatttgggtgaagacactgagccaaaccatatcataaacttatatggcatatgatgggaaacttttatttttccatcacaagtagagtggtaatatatacaaagagaaaatgggtatcaggtattggcaatttttattttcattgttcatttacatatgaatttttagtataaatttggagactttaagtattcatgtcagaaaaaaatatttcagtgaataagtttcagaaattcaacgtcgtatgttttttttcttttgcaaggtcagactgtagattcctttaaaaaaggactttttattgatagaaaatgtgtttatagaattttaaaatagtatattctgttcattatctctaattttctcactctgctatactacatgcaattatatgtctaatgttatttatgtttatttatataaatttgctgttaaaatatattcaattccctattcctctaaaaagaacaaaaataatgacaatttattcgtattttttttcttggctatgaactcaaatagatgaaatgttatataaattaacaaactttaatagcacgtattggtgatgtgcaagtcaatagttctcaggcatttaccttcctagcactttcctatttgctgagagtagaagcgtttgggagaaatatacaggatagtacatgcttttcaggaactcacacctagctggaagggcatacctaccacagtggaaacagtcagagaaaaatccatcttggaatgtgggaaaatgattgtagctcttgaggaatttagaaagggagagatctttaggggctgggaaatgacaagttactaatatgtagactgggcagttcctctgtgctacttccataagcaagtgctttatactcacactgttgcatgtaaactcctcaacatttctgtgatagaggtactgtgagatgttcctttcacagaagaaactgaggccaaaaaagtaatgtgacttacccaaggtcccacctgtcataagtggcaggctcaggcctcatttacatggaattggtgtttttaaccatctctgttctctttgcagtggttgtaagtgcctcggcaataaaatagctaaacaccatcacagagtgtatagagttctcatgggctaggcattgtttcaagtgtcttttcttgtgttatctcacttcatcctcatataagccctatggatcacagagaattatgtgccttgcctaaatctgtcatgcaagcaagaaagatttgtgttggaattgaagaacgggcatgatgttgatgaacatttgggatgaggcacaagtgtttgaatgggctgatctctctgaaactggcagaggcagggtgaaggtgctggcttcaggcaggaaggaggccagactgtagggcagattctcatttttgaactaaaggcatgcagtaggaaacctgagatttattcagaggagcctagaaataacaggctagaaagaggaagggaggaatggagagcccttagacaattgaaagactaaattggccagcaaggaacagagatttcccattctacaatgggaaagaaagatgtggtctaaggtctgtgttaatgaagaaatgctggattctgcagtaagctttctgggagtctccactccataagcgggaaatgtaggaatttgtatgctttaatcaagtatatttctcaagaccacatcagaagtttttcttttgtagagtctgcattgaaatcatcatatagtttaagaaactcacttcgaggtagggacaacaatgttgtagttagcattgacttaaaatgtgagaagcgcaaatgtaaaaattcttacttgggttctctaaaaaagaaagtatgataattgattaatgtatgagcagatgaaccttcaccagattttgaaagcaaacctttggaacatgtaatgtatttgaagatacttttctagattttcccacaaaggatcttagtgaactgatcattcatacttcaaaatagaatttgagaataatactgtttgcaatcaaagttgggaacaaatctcatcaatatgattgggctttgtgtccccacccaaatctcatcctgaattgtaatccccataatccctataatcccaacgtgtgaagggagagatcaagtggaggtggttgaatcatgggggtggtttcccccatgctgttcttgtgacatatggtgaattctcatgagatctgatggttttataaggggctctttcctttttgctcggcacttctcctttctgccaccttggaagaaggtgacttaattgacatgtgagtcaattaaacctctttcctttataaattaccgcatctcgggcagttctttatagcagtatgaaaatgggctaatacatctgtcttcactatttactagttataaggctagtaaatagccatatgactgtatggcataatttaatttctctaaaccttagttttcttatctgtgaaatgggttaataatacctacatcatagaagttatagtgtattaaaaatagcacatgtaaaatgatgaacatgaagccaggcacatgtaagcaatctattaacattatcatcattttcattgatgttccctatagagacagtcatctgtggatttgatgcaggcaaactagatacctttaataaaaatatgaggtagttagcaactgcaaaggaaccttcttattcagagctattgttactgtcagcagtgttaatatattaattttgcttggtcattgactcagtgtataaaatatgtgggcagtgaactgaggaagcttagggaccagtgtgaaaaagacatataaatcatattaatgcagtagaagtgttataatcaagtgtatttttaatggaagcccatagaatgtgcttttactgtatggttagctgagtggttagccgattggagaagtgggcaggaaagtgacatttgagtctagatggatgagtaagagtctacttgaaagatgagagtccaaggaggttgcaaacagaaccctctctgccaccagaagcatgaaggtacaaagaaaatggcaggcagtaagcatgcgagatgttaactatggaaagagtgtggagtacaagacgagagaggcatgagctaaggctcaatgaggaagggcatcatttgttatatttcacatttatttgccataaaataggcttaggacaggtgtcttgatcgttaagtgcaaaagtcacatgatcaaatttatgtttcagcaagatgatcagagatgatgcaaatgaaaaattacagggagagaaactgaaaaaatattgttatgttttaagtgaaaagtaatgaggtctgcgactaggcaaagacatggaagataaatggttgggaattcaggtggaagacttttgggaactgcaagccattgaattgtttactgaatgtgggaatttaatagcaagtgaattatatgtccacatttgaccaataaaacaatagtgacatccttagaatcaagcaggaaatgcaaaatgaaaagcaggatttctttgagcatgtaagggaatttaattctcaataatttattgatttatttttattttttatactttaagttctagggtacatgtgcacaacgtgcacgtttgttacatgtgtatacatgtgccatgttggtgtgctgcatccattaactcgtaatttacattaggtatatctcctaatgctatccctctcccctctccccaccccacaacaggccccggtgtgtgatgttccccttcctgtgtccaagtgttctcattgttcaattcccacctgtgagtgagaacacgtggtgttcggttttttgtccttgggatagtttgctgagaatgacggtttccagcttcatccatgtccctacaaaggacatgaactcatcctttttaatggtggcatagtattccatggtgtatatgtgccacattttcttaatccatccagtctatcattgttggacatttgggttggttccaagtcgttgctattttgagtagtgccgcaataaacatacgtgtgcatgtgtctttatagcagcatgatttatagtcctttgggtatatacccagtaatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatcttttcatgtgtctgttggctgcataaatgtcttcttttgagaagtgtctgttcatatccttcgcccacttgttgatggggttgtttgtttttttcttgtaaatttgtttgagttctttgtagattctggatattagccctttgtcagatgagtagattgcaaaaattttctcccattctgtaggttgcctgttcactctgatggcagtttcttttgctgtgcagaagctctttagtttaattagatcccatttgtcaattgtggctttttttgccatagcttttggtgttttagacgtgaatttcttgcccatgcttatgtcttgaattgcctaggctttcttctagggtttttatggttttaggtctaatgttgaagtctttaatccatcttgaattaatttttgtgtaaggtgtaaggaagggatccagtttccgctttctacctatggctagccagatttcccagcaccatttattaaatagggaatcctttccccattgcttgtttttgtcaggtttgtcaaagatcagatggttgcagatgtgtggtattgtttctgagggctctattctgttccattggtctacatctctcttttggtaccagtaccatgctgttttggttactatagccttgtagtatagtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcatcgaatctataaattaccttgggcagcatggccattttcatgatattgattcttcctatccatgagcatggaatgttcttccatttgtttgtatcctcttttatttcgttgagcagtggtttgtagttctccttgaagaggtccttcacatcccttgtaagttggatccctaggtattgtattctctttgaagcaattgtgaatgggagttcactcatgatttggctctctatttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaatcgaatacactttttttctttctcctgtcttattgccctggccagaacttccaacactatattgaataggagtggtgagagaaggcatccctgtcttgtgccagttttcaaagggaatgcttccagtttttgcccattgaggatgatattggctgtgggtttgtcataaatagctcttattattttgagatatgtcccatcaatacctaatttattgagagtttttagcatgaagggctgttgaattttgtcagaggccttttctgcatctattgagataatcatgtggtttttgtctttggttctgtttatatactggattacgtttattaatttgtgtatgttgaaccagccttgcatcccagggatgaagcccacttgatcatggtggataagctttttgatgtgctgctggattcagtttgccagtattttattgaggatttttgcatcaatgttcatctgggattatgatctaaaattctgttttgtttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggaatttttttggttggtaagctattaattattgcctcaatttcagggcctgttattggtttattaagagattcagcttcttcctggtttagtcttgggagggtgtatgtgtcgaggaatttatccatttcttctagattttctagtttatttgcgtagaggtgtttatagtattctctgatggtagtttgtatttctgtgggatcggtggtgatatctcctttatcattttttattgtgtctatttgattcttctctctttttttctttattagtcttgctagcggtctatcaattttgttgatcttttcaaaaaaccagctccttgattcattgattttttgaagggttttttgtgtctccatttcctttagttctgctctgatcttagtaatttcttgccatctgctagcttttgaatgtgtttgctcttgcttctctagttcttttaattgtgatgttagggtgtcagttttagatctttcctgttttctcttgtgggcatttactgctataaatttctaaaggctttcaaagtaaaaaatttgaattatagcacaaatgtgtcattttagaaaatgccaggtttataggaaaaagttataaattgtaaattgtgattttatcttactgtgtcaatcagaacagagccaaagatgtggcttgcaatttactttaagaaaagaaatcacatatttgtagaatattttgtaattttcacttctcctttccataaactgccttgtttaattccttgaagagtctcactattctttcctttatgagggttctacaaatgtcccttaagcaaacactaggtataaggaactgtcctaggttccggaaacacctcactctcacagaggatacattctagggatagaataggggagttataagtatctagaatagaaagtcttaacttgggccctgagtagtatttggggatagtgaggtatacacgatctcaataaaatttacgtaaaatagttctaagaagagacttttaccagatttcaaagactttcataatcctaaactggttaagaatcatggttttcaaagctgagcctcaaagaagttagctgacttgctcaagttcccaagaatcaagttacaatttggatcttaatgtactgtgcagtgccattcaacccctcattgctaattgtcttgccatctttatctccaaagaatggtcaattttcctgagttctaatacattcctcagtttacttattataaatgtcacttccaatccggttgcagcaattaataattttgtaatatagctggatcgactttaatttcttttggctttaagtgcagagacatccaatcctgctagttccaaaggtgttttctgaaggcagtgttcccaaatcactgttggaaaggaatatggcaaggctcctgaagaaattccggtggaatttctttaatcatctggtggaagtggagatgtgtgtggttcctaagaatattgtgagtcctatatttaggacacagaccaatgcctttgaaatggccttcttggcttcctgcagtgtggagctgtgatctccatggtgagatatcccttatatttacacactgccacctgacctttgggtcagggcatttccaatcgatttaggagtgcagcaagtgcaacgacggtgttgatgagctcttacagcatggtaagcaaggctgcctgggactgaggggcgtgggaactctattgatttttaggtactttttatcacatactcctacactgctggactttgaattaagttagttttcagacaacataccagagggcaagaaaacaaaaagtgggatttttacacataccctggaaacaagttaatttttcctggggaaatcaagtagagagctggttaccatcttagcaattaacagaagttagacaaaatgtttaacaggaattggctttgtggattatggcattgggttaccagaacagcaatcaaaatgcacctcagtagtctcagtttgttagaactgtgtctcacttcaaatataactttgctctggaagaatagagagtctcaaattcacttgtgggatcctcaagaattttgcttctctgattgccaagcattgaagcaataatttgttattgaattgaagcaagacaacaggaagataattttatatcagcctgatggcgttgtttactgaaactctaataagcttttgggcatgtagtatgtgtgtgtgtgtgtgtgtgtgtgtgtgtgtgtgtgtgtgtgtgtgtgtcttgatttagggttaagtcttcctgatttgaaggaataattttaaataatattgtcagcatggccctgtgattcaacatctgttgctgtgttttttcctaaattccagtcttttgtatacacttagaaatttggatgatttacattggatgcttttttttttctgctcacttttaatctttacagtattttctgaaaggcagcatcaaattctgaatgggcatcactgattcatttacacatctgttaaaattttattgagcacatactatgtgtggtgtaatgcactactttccaatgataaggaatttagataagcaaaatgtgcttcaggtcgtcaggccacggtgattataatttggagagactgtaggtaggcaactcattacaaatgaagcagaatgaaactatcactaaattgagtaggcaggaatagcttactctggcagaaggcacctgagaatcctaattgagggaagacttttaggttttaagtaagcaaatccaccactgggagaatgacaaaccctgtcagtcacatgcctttattatcatggctctgctttcagtacctcccggttgtgatatctgtactcttctctctgctcatccaaaaagtctgcattatttcatgttaagagaatagtttgatatttactattggccaaagcaagaaaggctttgcctactccatgctatagcttagtatttgtggtgtttcttcattattggtgtacttctctacaggatttctttatgatggtttctgtctttagatactgacctaaattattacttgccctggccttttggggaagaaagtcataaaatcaactatgccttagatctgcattgtcaaatcggaagctatcaaccactgtggtcaatgagcacttgaaatttactagtcccatttgcaacatgctgtaagtggaaaaaacacactgagtttcaaagacctggtatggaaaaaaatgtaaaattttatttttatttttatagtgaatacaggttgaaatgctgagaactttatacatatatctatttaactatacatatatttaactaatcaattttgatttattatatataaaaattatatatatatttatggggtacatgtgatattttgaaagatacaatgtgtaatgatcaaattagggtaattaggatattcatcacctcagatatttattctttctttgggttgggaacattccttatgttctcttccagctatttcaaaatataggttaaatttattcataagttttttttttgttatcccttataaatgtgattgctctcttgatttcttttagagattctctgctgttggtgtattgacctgatactgatttttgcatgttgattttgcatcctgccattttactgaattcatttatcagttctgctagtttttttggtggagtctttaagtttgtctaaatataatatcatgtgtgaacaaggataatttcatttcttttttcacaatttgggtgtcctttatttctttcccttgcccaattgtgctggctggaacttctggtgctatgttgaataaaagtggtgatggcaggtatccttgtcttgttccagatcttataggaaaggcttgcaatttttccctattcagtaagatgttaactatgggatttttataagtggtctttattattttgagatatgtttcttctgtacacaatttgttgagagttttcatcataaatggatgttgaatgtaatggaatgctttttcagcagctatgatcatatggcttttgttcttgattctgttaatgtcatgtatcatgtttattaatttacttaggttgaaccatccttgtatccctaggataaatcccatttgattatggcaagtcaatttttttaacgtgttattgaacttgcatgatggaattttgttgaggatttttgcatccatgtccatcaggagtattggcttgtagtttccttcttttgttgtgtctgtgtctggttttggtatcagggtaatgatgggcccatagaatgagtttgaaagttccccttctcttcaactttttggaatagtttaagtagaattgttattgcttcttctttaaatgttttgtggaattcagcagtgaatctatcaggtcttgggcttttctttgatgtgagacttttaattgtagcttcactctcattacttattattggcttgttgaggttttctatttcttcattgttcaatcttggtaggttgtatgtgtgcaggaatttatccacatttttttaggtttttcaatttgttggcttatggttgttcagaatatcctctagtgagtctctgaatttctgtggtatcagttttagtatctccccttttcctctggtttcattgaattgagtcttgttttcttaattcgtgtagctaagggtttgttgattttgttcatctttgcaaaataacaagttgtatttgttgatcttttgttatttttgtatccttaatttcattttttctgctctgatctttattatttcttttcttctactaattttggaaaacctttatacagtgggttaaagaaaatatcttattaataattaatattaatttcacctgtttctttttcctttatttcacatggctaccagaaaatttaaaagtttacatgtggttttcattatatttctgttaaacagtgctgcctaagatagtgcttatggaactgttgtcacaaaacttatgtataagtgggttaaccgagataataaagctgaattcaaggtgtgtagaatgagcactagactgagatccagggactgattcagtcccagctaggacttggtctcctcaggtagccattcactctacgtgtctggaatggagtgcactcactgaaaaaatgcggaaaagattgagaagtagatcatttctaacccccttcctacattaaattcagtgattcaactgtgttcaggagtatacgattgaatcatacttgtagccctcccagtatcttctcaaagccttttagacaaaaccgtcttcctcattccacatcataatttatttgagaggttaaatttgtaattactgtaatttggagcttccttgatcagcctgaggctggagcacagcatccttcaatctgttcagtgctaagtgaatcagttgaacatgttgtgatttataaggatctgataaatatgttttgcaagaaagtttccagcactctttgaaaaaatttagagtgttctgaaagtaaactgtagtttttatgtcatttcaaataattaagaagaaattgtttcttattttttaaattaatattgaaaaatctatttctaacttaaattcacaggtaaaaaatgtggaatacttcatatatttcttataatattaaatatcttattaatattttatatcttacactttgatataaagaaatataagaaatatatataagaaatactctagccatatctgacttttttccatgtacgtatatttgaatataatatagattgtagtgtatatgttttagttttttaaaaaagttttaacatgtgttctactttggaacatgagtaatttataatattttttcttataaataatagtatgtttacatgtgcatatgcctgagataattagtttaggatcatttcttaatagagaaatgctggtcaaaggacataaatattttaagattttttcatatttataataaactttccttccaggaagtttgtattttccatttgtgtttcccttagcagggactgcctgttccctgcaaccttaccaatactaaaattaagattttaagttttgttttggttgacgagtgagaaaacatactttatttttgttggaatttatatttcttaggttactaagagaatccaaaattatttaatgagcatattggcaacttctaattcttctttgtaaatagcttgttttgggtttatatcgtctatttacttacttattttggatagttttttgttttgttttgttttgatagctgagctggtgagattatatagcacccttgaaaactttcctctttgctctgacttccaatcctgttcagtcatagacagccctgcccctgctccatccacatgtcacctgagcaaacaagcatatacaacagggggaaatcactgtagtcctcatcttggcatgtgggttccagaaaataatcaagcccttataagaggaagaagataatttaactcccatttggtccttatattggagtcttttagagcaattttttctagtttttcctttccaaagcaaatgaaaagaccccataacaatactagctttaagatctctgctgtaaacaaggattctgagtcaattgggataccacaggttagttacgtgtacactggtgtatccccttgcaaaatcacctgccttgagctgtcattacagaaccattataagaaagggccatataaaatataaaatattttaataaattggttgtgaaaatattgttatggacactgttttgtataacactgacattccaatacacaaaggatgcattataaaagatggagtgctagaaaaagctaaagtgctcttcaggtttatcttgcttctgatacgtgttactgatgatgtttcgggaattgcttgtctgcttggaaactcagagccaaatttgattcttaatcacagcaataatattggctgttagtattgactattttggtaatgtatttttatgctccaatttatatattacctataatttctgatttcattatttggtaaatttttttgtgtggatttttgtgtgggtgtgtttgaattttgtctgtctgtttgtctgtttgtttgtttgtttgtctgaaggtttttggaaaccttcttatttctgaaaaagagcaaggcctgtgattaagaagagtttttgcaagttcagtgaatactgtcatcattttcataataactttaaggtttattacagaaaactagaatagatttttgcctcttcctaggcaaaaaaagctgttgttcccaagcagaaaggtgaaagtcatcttgtattatttcttggcttttcatttttatatatgtttgcttgccttaatgataataatgctctaatctaattatcaatcacctgtttaatgctattatttctgttaattcatgggggcagctaatgattttaaataaggtagttttcacaagaataagtgaacaacatgaaactttttgtcaaatcaattttctaggcatcctttattttctgggcatcctttgggtttattcagtagaatagtctttggaaaatttgtaaatcatgcaataattgaaataaccaaaatactgtctccttatacacattttacataggaatatgctttagaaaactaagcaaagtataagtaaagggaatattacagaaaggtaaatgtcagtgttcttctattcaaattatgggctttaatttccccagccttttggtggtaagtgaagccatccttgtcttgaaaactgtagggggaactgtttacatggcctactttagacccttatgttattctgagtttttttcttctccagggaaataatttttaactatgtttgaaagaatgaatttaaggcttattaactgaactcgtcttcaaaaatttagaaacgatggttctgtcaaatcagataattttcttcctgtgcattaaagcataatatgaggaaactattagctacaaagcacatttaaatgctgcttggatattggtgtgcccttgctcattttcttgagtgtttctcaattcaaaactcaaaattaactgcatacttggcatcaggtcttgccatcaggttgaacctgagctgatgtcaatgacacactgctttggagcccatgggtaggtgaggggattgcagtctctcttcagtgtgggattctgaaaagaggcaaactgatagaggctccaaccaaataactgtacccacacattgagggactgaaggtaaactcccagagaagagacaaagacaggaggtggagagcagaatagtcaggaaacaagttagtcacagactttactcagatccgggttgtgcaagcaatgcagacttgactcttttgtcccatccactactcactgcccactgcactctttttggctgggttgtattattaactgctgggaatatttttctcaacttccattagagtggggattctcatatgagtagtagtaagtagaatagtaggaagtaagtaagaagagtagtaagtgaaattctgaagtactacctcttcctgcttttttctactggccttaaacatggatgcaatgtctggaactgcaatgattatcttgtaaacatgaacaagagatgacaccatgcctaggaaacactgaatttctgcctgcttccagacttctggtcataggaggaaaaaacaaaacaaaacaaaacaaaaacccccattagaagtcaaaatttctgctacttgagttcaaatgcattcctaacttatatactttgttgcctcgtttgttgccttctgctcttcaatagtctcactctcattggggaagaaaaatatataaacttaaagttcttattgcgacacttcttaatacctaaaattgccatcctgttgagccaggatgatcctcacatatgaggtacttagtagttgcttgttgaatggatgtgaaaaatattcctgtttttcactttggccaaattgaatgatagaaacgctttgggcttctctgacctggcagttccacagtgcaaagcaacattctgccctcagatcagcacacatctttacttatacaaaccctcactctggggtgcttattgttatagaaatctgcttctgtttttggcttccctgatggaaggaaaaggatgcctcagttcctggatgtattgtatgaaccttggctatacttacataaagcacaaaataactaagaaatatgctcaccccgtaaggatttatgtggagctcactcacaaatactttcataactgctgagaatcagcacggtttggtgcgatgttgaaaagtcatcagaatcaaaaaactatgtgtccaggtgcggtggctcacacctgtaatcctagcactttgggaggctgaggcagatggatcacctgaggtcaggagtttgagaccagactggccaacatggtaaaaccccgtttttactaaaaatagaaaaattagccaggcatggtcgtgggcgcttgtaatcccagctgctcgggaggctgaggcaggagaattgctttaacctgggaggtggaggttgcagtgatcagagatcgcatcactgcattccagcctgggcaacagagagagactgcatctcaaaataaaaaaaagaatcaaataaactctgatacccatcgttaccaccattggctgtgtgctgtggagaaatttagttaacttttctctgaagaagtattccttcctttgtaaaaatagacataaatatgccagtttcccaaagtgaatgggattaaattaaatcatgtatacatatataaagtgtttggcatgtagtaagggattaataagtgatacctgttatattaatggttgtggttatcttgcaatatgatagttgaaagatgtgctgattcaaagctgtcaacccaacatcttcctgggatctcacctgccttgctgtattatctgctggcgtctccaagggtgaccagcttgaacgatttcattatgtgtcactactacaacattttacacaaatacaattaaacaagttcgtcttccagcacactagttgggagttaaaaacagtttctattgatttatatttttgatggacttcattgagaatgttctgatttgtgggttaatgctttcttacattgagggttcccaggagccctgcagtgaagatggtaacctttacctaaactcaccagaatgattaattaatgtttacctctaatgagctaattaggagtttgggacattttggcattttgaatggcttacttgattatctaaagggaacttttaccatctcaagaggaattataattggccttagggaataatagaatcacctaaagtataagaaagcctccctcatgttggcaaacaacctgtctaacaaatgtcccctttgacaaaacagcccgcagtcacaaatacgagttgaaatcgtaaggggaactctgacaggatttacagttacattaattgctcgctcttggcatgggtgatttttgtgattagaagaggatcagagcagctttctactcaagtctttggcttgaggctgatcattctccataaacaatgacacctttgggagggcagccaaaaatgtcccatagagaaatatcaggagagattcttacttaatgagatatgaataaggctgttgagctccaccagatctttgcttgtctccttaatgaggaaacatcacagtgggtgaagtggtgataatgttaataaccatgatccaattcaatgaatggtggaagtaaggagagaattcaggaaacagacgtaacacaactctctatacaaacctctgggtcagttatgtaacttgattttatgtttatcttcaagtgagggagttagtgcgcctggcttatgcagtagttacacataagacatgtagatggaagtctaataagtgaaggagactaaatagaaagtcagatgtacctcagggagaaaacgtgattcataccaaaactcactctacggagtgagagagctactcagcactttaatggaggatatgatcaagacttgattttccatttcgttttcctttttggaattatgcacttcccaacagaaatgtctaatttggaaaaaaaaaaaagggacctccactgtcaagttgggggaatgagggcaggaaggagaaaatgaatataaaagaaataaatgaaggacaagtttgcaaaaaataggttgtgcaagaaccaagaaggtttaaaacaacgttcagagtaatgagctcaattcactaggaatggggagttcttgaaggaattgaagcaaggagattacctgattagagataggttgcattttaggtaaaggtagaaataattattggaatttagaaaacctcccaaaatacctgattataaaatcaaagttattatctagatattcaagtattaaataacttttaaataacctgaaacacatggatcttcacatatgtgaagaaagcattttcccagccacattcattatccgtaaaacattttacagtacctgtcatagaagacccgtcccatttatatataaagtttcatcggtgctctttaatgtcacattattttaggtatggttgtttcaactgagtgcacacatctattagtgctaagtcacattggataatgaagcactgttattcccacgaacctgtgttaggtggaccagggattttaattaaatatctgaatgagtgttgtaaagtggatactctctagaaagcatctgtcagggttaatactttacaagttagctatgcctctttcaacctttaattataatattctaactctttatccttagttactgctaataatttcaaggttatacagatagaaattacttgattatccaagtgcctgcacttatcgaatgaaatagaaatcaatttcactgtacatggtttataagtaagcaatgctaacatattattgtatttttctaaaaaaattctttttttaacaaaaggaattgaaaaccacatgatatcctgtggttgaaagtgcctaatgcctgccacatatgtaacaaaagtaaattcttaataataacagtgatagtcctcctgcatccaataaacaaacgcacttcttgatcattgacaattcttcagctctctttaagcattgatctttagtccttattaatttctcatagtgtcctgcttggcccccataagtccatttcatcatttaagtatatggccttgccacttccttccccacaagtagactttggccatttctatggatgcagcatttagaaaagatttgctttagcccttaattttcagaatcataaagcacatcaataattttttcacctccaagccaccccttcacaccaccttcatgtgggctgaccaagcagtgggccattcaggagtcaggcagttgctgttccttgttaggagaagtagaaagccatgaccccagcattgatatcaaatcttttaaatattggttatggggtattttgacttttatcttgtttgattcttttttttttttttatttccaatcactgttttgataaaaatgtgttaattatatgcttctgtttaagagtcatgatgttactcttctgttgatggacctgcaaacttcatttattataagacaatgagaagttattattctccctaagaaagctagcttagcattcattttaagaatactgaagaaaactttgattctctaactagaaaagagagattaaaagtatttaaaagtacaaaggaagttttttccctctcaggcctctcttggttcctggtttgttgttgttgttgttgttttttctaatgctgcttcagttaacaatgccttgtgctggtatgctattttttaaatgcaatggagggaacagatagatcttcattcttcctaagagtagaaaattctcattatggagactcataatcttcaatatttgaagactatattcacaccagatcagaataatgataagttaagcagaattgaaacatattgaaatcatatttgacactggaaattctttaattctatgagaactatatcattatagttctcattttataagaaagttatttaatatattttaaggatgataatagcacattgtgcgttaactttgatgtctctttctttgacagtttggagactacattggcttgcaatggagaataaaatctcaaccatattaatgggatcatcttttattctccaaggcctaagtagtttccagggcacatgatgccccttatagatcctcatttgtccttacagtgtcttcattctggaatgtgtaactaaagtaaattccaaaagtaaatgttaaagaatcatttttaaaaccaagtaaaataatgaccctcatgctgatataaaatgaacacatattaaatatttaactcattaatgtaggaaccaataagatgttgtaagttcaaaggagaattcaaagaacagacttaattatagattaggaatattgaaaaaaatgtgaaaattgaaggaaaactggcctgggccatggtggaaaaaggaagccaattgaaatcctgtcagacagaatgttgcatttctataggaatattattttttgcattgctaatggctattgacaacttacagatttgtaaaatggctcaatgcaaggttggaatgagatttcctggaataatgtaccgtagacaatgcagttttccctgaataacacatttttcccctacagtacattgttccctctttattggataactagtatttaccattaagattttgctcaagcatgtaccataagaagccttccctggtaccttctgtctgtttttaggtttccctctacctctcaaaatagcttataaataacaatcactggtctctatacatggcattataattccatatttatgatttccctcagtccttcttctttaagaccagaactatacctttttattttatttttgcatagtatttgtatagtgttagacacctagacaaaattgacaagttgcctacagaatgaatgagtgaatgaatcaagtagtgatggatgtatgcttgtgtcaaatttacatgagcatgtgtgataggaaaacatttgtcatgcaggatgcatcagggatttgagcatggtccctttaactctgagcattgcacagctcatatcattactaaattaaactctatgcttacctgactttgctacaaccttactctctgatcccagaaaaattctgtataccttgaaactaatttatattagtgaaatacatattctttattcttgcaaaactgcctgtgaaaatgttttttaatcataggtcatttgacattatagtaatatatttgcaaaagtggaaagttttgcataagcacaagtaatgatctttaactaccttagaaatgatttaaagtaggtggtcaaagaatctttacttttctggtatttctggcattatggcaaaagcaacgaagcaagagctagttccttctctttacttccttcctgtaatctttgcaggttctttgtacatgttaggaaataaacctttattagttgaatctctaatctgttagtacattttttaaattacttagcattaagtctataatgagtagacagagaccatatacatgacccattatttaaaggttcttaaatttcagatatgtttacacaaaattgtgcttcttccgaatccttatttcagatgattcttgtttgaatatatgttggcacctgtatgttcaaaacagtggaggtgtcttggaaaccgcaagatgcatcctgcaaaaaggtagagggtggtagagagtgtcctgagttttaaataagtagatttttggatttgaatttgagctctgtcaatttctatatgcatgacctgaagcaagctacttaatttctttctatttcattttccttatatctaaaatgagaataataatcctgatttcatagagctgaggtgagggtaaggcagacaatgaatgcaactgacttatgaaagcaactggggaatgcattcattccccagccattccctggagtacaccttgttttatctgcatttgttcatccctgtttcttactccttgtcagtcaccaccttctttaaatccttcatggttgagcttaaaacccacccgttcctgccttgttgattggtttttcttgtcactgccaagtagactgtgggctcagtgagagcagaggctctgctctgacttgttgagagaccccagagcacctcctacggtctggcagcccacacccagtggactaaaatgcagccctggcaccatctttctatacttcttttctcagaggtgttgcctcattttgacctgtgttctctagaaacccaagaaattttctctaaagaacagacttaaagtgaatatagtttactccgtgctgttcatggttctgaatagagttggcgcatatatagtgggtttgattttctttaccaagctgccctgtagttcgagcagcttgcacatatgcttccagatagactcgcccagcatgccttccagaatccaatacagcttcagaattccagagagtgaggactgacctagggtcaaatgcattaacctgctccatcaccaaaatgctgctggaggattgaacagatgtgtgtcaatgcttgtggtatcagtaaaacatacgaaaacatggatttattttaactccctgtggtctgaagctgtaaggtagagatacaaaaattcatacactgtgattttttttgctgttattttcttcttcacagtgtatttattccttctgagcatctttggccatgcactgtgttttctttaatgaaagtagaaaatttgtatcctcattgcttatttttagcactgttgctatgataaactgtagcctaggcatcttattaaaatcaattgaggatttgaattattattccctttaatattgtggcattactattctttctgaaaatatttcaccatgtatgaatctatccaaatatttcctatgacttactggaaagatatttctcatctatttaagggatatataaaaaatagcctcataggggttggggacaaatgtttttgttttcctctggattgtttttgtgggaaagtgttaggtgcaattatttttttcaatactctgcttaagaataatttgtaatatctttaggatgaagttgcatagtacaaaacaactttttgtgaataaagtaattgacaattttggttttaattaccacatgtcatgactagtagacttcctaacaaaacacatagattgggcaacctgaatttttctacataaaaattgaggtcttacaatatcatgaggtcttacaatatcagtgaagcaataatctgcattccaagactttatgctgtttcacatgtgtaaatagcaactacagcatctactatttctgccatggagtctgggactgtttcaaggctgttcatctatgattttcattctcagtaccaggatcatgggcaggaatggagcttgaagagatctgggcccactcacaagggtttttaagaatcaggagatggtaattattaagaggaggtaagaactgagttgaacctaaagggtcgacttatattttaggctgttagaccagaattatacctccctttaaactagataaacatactagcataaaacaacctgcagtgatgaaggggaggccattaaacccaaagagtcctagttctaggccaagtgttaggctatctgctttcgtaagtacatcccatttaatcttcctaacaaccctgctaggcacaagttattatccccatttcacagatgaagaaaccaggctcggggagattaaataacttcctcgttgtaaggggttgcactggcatttaagcttagcccttatgattcaaagcttatgctttatgttatatgatgctaaaataaaggcatggtttttttcccatggaagaatatccttcatattttttaaagttgtagtaagtagcacataaatgagacctactcttaagaaattttataagtgtatagtacagcattaactataagcacagtgttatatagcagttctctagaacttttgtaacttgcatgactgaaactctatacccattgaatagaaactctccataggtctttacatctataactaaattctgatcacccattcctgtcccggcactgcttatttgtttgttggttttgttttgtatagagggggaaaggtgccacattaatgccgagttcaaggtcactgtttaacgaacaggtcttggggtagcaattgctataacatgtcaatagccagattcaccataaaggtgatcagactactaccacgctgttttattaatcactgtatgaatttgattataatttataatcaccaacatagtttctgttccatttaggtgacagactgttgatttactttgaattccaagatgacagtgcccctctgagtcaggcagggtatattttaagtcacagttacttgagaagtccctccccaaagcagatcacagacatcacttcttcatctggttgagaagcttctggatggagtcagactgcctggcagatcctggctgcactccagagaactatgagcactgccagacagccccctggcactagggctggccaaacagtcatggcacaaggatcctctgtacttttactgggcaccaagcccagctccatcagggcagaatgtggagctcagcagtttgaagtctggtctccatggcactagggccaaaggcaagctacagaaattccaaggcaactgcattgtctctggtgtaggcacatgacacattccacccaaaaaattaagagaggctgtatcctgtccctgatccaaggtaggaagaaaattctctccttttcccttctttgttcacattattcaaattgctttcaaacggtttgaaaaatcgatttttttctaataaactcatggtcttttaaacaggtctaacagcattggcaggatctcatatgaatgagcacagtactagaagacatcacgatgaggccttattccaacttcaggttgcagtgtgttttcaacatggcacttaaacttggtgaacctcagttttctcttattttaattacaatattcatggcatctgcctcacacgggctttccagggttgttttgagaactaaggggaaaactgtgtgttcaagaatttggcaaactggggacatagtgtgtgtatgccatgtttatgaatactcctaagtaagtcaacttcgtaagggttgggtctctgtggcatacagaaggtgctcatgaatgcctcaaaagtcgtggaaaggaatcttagtgtggggaggggggagagagagagagagagcaaaaaaagaagaaagaattcaaatctcggaaaacccaaatatgcttttgaaattagtaatctacacccagtaaaaatcttaaaatcttgcttttgttcattatgggatacccaagagatttaatctttcactaattgtttaaaaatcttttataaactgaaagcacacccaacattaagagttctgagcattctgaattacttacatttgtaaaattccttttgaaaaatgtaaaccaagcttatttcataatggtttcttcaaatcactttttcctattgtagtgtcctttactgtctatacacgggatcacatgttaatagtaccaactgtcctgagccctttccaaacaccaggctgtatctaaccctttatcataagatgtctcattgacttctcattgcaaccctaagatggtcatttttaccattttacccactttgcagttgaagctggttggagcagttacataactcaagaaaaggggcaatgctcataagtaagaagatgaggactcaatttcagactactagaagtcacaacccatgagttttgttttgttttttcttcaaagagccattcaagactccatttgccaagcctagacatggcttttatggagtgaatttgatctttattaatagctggaggcactgcataaaaggaacttctggccagagcctagtggtagttaatcccagtgacccagcctcattcattcatctgtttgcttctgggactaccacctgaacatttgttttgtcttggcttcttccctgcagcttgatacttcacatgtgtctctgttctgtctctcccagttcatcaaactggtttctgtcatcctcttttccatgtttgacttcttgagcactccacttgtcctccctgatcaacactagcctagtgaggaagagagaggccatgtattctattttcaggttgttttatgaagcagttaggccccactgagctcagaggagtgtgctaaggaagtctatggaaacaatgcacagttgtataattttgttttgaaatgtgttctgataatactttttcaggcatcaaagttgcctaatccctaaaaatatacaggtgtattatataaagaggataagatattatgcagcttaaactcctggaaaagttctcattagttatattttacaaccaagttccaatgcgaagcagcctgtttgtgagtgatgattagcgctgccaatgccccagcagtagcaggaaagaatgtcatgaaatgatccaacttccattagaaaataatgactgtcttggctgagcaacattttttaaattaaataccaacaattcctagtaatcagagagcctattagccatgaaattcgatttcagtatcagagactattcacttaccaaatgggagccaaataattgtgagtggaatttacagtgccgcattggggatagtagtaaatattatggaagtggcactagggtatagcttcagctctggggaaatgtggcattttaaaatttcagtagcaagttagtgtgatgattaacagaatgcagtcattaatttccaaggcatgatattttctctttagtcatttgagaacccaaggtcttacagtgaactcgtcattaattgctacttagcttcactgggcttttccaaatgtccatcagctcccttgagataaaatcaggaatctttgcattagaattagccttaatttatggagggaggtgttcttgatcccaggagtgatctttaggaagactggaaaataagtttatcatttctgccagctcaggtctaagtattctctcttcttttcacatggtctctcctgacgcatcactgcccaggtcacctcttcaatccttcctcattctttgcaatccctgttcagggatatgggaagaaagtattcactatctacttctgccatgaattgtgtcaagtaacccagacacaaatagtggaagtatattattaagcaggcccatgtagattaaatactgctccacagcacaaagttaataagggttaagaaggaggattcatacctaggtctatcctcagaacacttgttctttacattattgcactatggaaataaaagttgataaaattttaggtgaatacattgctctgccattttctaatttcgttttaatacattttgaaggaaacttaagcttggaaattaatgttttccacatgcagcactaaattccaccaccgtctttcaacagtacaaatccaatggaggaactttcagtatttttcaaacatatatatacatccatgcatatgtatacatgtatagtatacacaaatatacccatatgtatacacatgcacacacaaacacagacatatatacatatatatacacttatatacatatatgttatatatacaatatatatgtaatatgtaatctttcataatatctttcttttttatccatgaggactgaactttgcctaactgaaaaatctctctcttggcacccatatatgtgtctctacaaacttgttggcaaactgtatactggcacatgcattctacaagaccaccaggctcaaaagcagaacatttggcggatagaaactgcagtggcaggctttctaaagaataaggcaggagaagaaccccacagagatgcatggagaagataaaacaatttgtctgttgtcacaccctaggaagggtcaagccaggcattcaatccatacttagctggtcccaaagtccatattctgtccactacattaacctgctgctgtcagaaaaagaaaatgacagatttatagttctcctctccctgccccagtatatgtcagcatttttaggtatatttgaacaaaaactgaagttcatgcatgtcaattgttcttctaaaagccttcttagtggaaacatagggaaacatggcctttagacatgcccaaagtgaacacatttgttagaaaactcagtgttatgatgtatcatttagagttaacaggtaaaacattgcatatcagctgattttaggaaggaccaaatgccatgcatatttctgccatgagtgctttttacttgccatagtgggccataagtaattaaactatgtcattcgcatttgaaaataccatgactacaggccttacaaatagtctccttcctaagttctgtggctgttagaatctgggaattgacattgtttctttttttgtaaggagtccttatggctttcagatcccttactggaattcttgccacaagagggatactgagcagtgaaggtttacaagtctcccttgcgcttgtgcatatggattaacttcactcttttaataccttacttctccatcagttctagagcccactgtgagctgaggtgaaggcacattttccctcccaacaggaaagtgaccaatattatatttacttcctggggcaaatggctttctgtcagctttacttgtaaatctgcctcattctactggatctatctctaaacctaattgcttgcatactgcccaaagccacctttgggagctatttgtgaagactttgtctcatttgtaagctacaaagtctccaaaacacatattttccctcataatcagaggttgtttttgctttggtcaggaacaacattcctcaaaatatctgtagggggctaataagtcacaaagtgttcctgagtagaccaggaggtgtatgacaaagatctatgtctttctccctccttctatccttctctctcccttcacccttccttccttctttccttcttttcttcctttttgccatatgaaagaagaatggtctactgatctctctctctctctctctgtctatttcattaaatggcattgcattgcaatcttcccaacaaccaaagtcagagttgaagatcattcagtccaatctccttattttacagttaaaaaacaaaaacacaaaacacaaaactaccccagatgggcgaaatgacttgatcaagtcacatagtattgggcctagggcctgaacccagattctttgagtccaagtacagtttacttttaggtagttagagatataaagtggccactgagatacagtgcaatagaggatttccggctttttccccatccaaaataatctcagtcaaagacagtttgagggaatatactgattttgaacacgaaaccaaaattatagagaacagaatttttttaaaaaaatttgagtatatttaatttattgaaaaatttaaattggatattatttgtttttgttgcttttatttccaatggcgatggcatttggaactgaaatttaaaatgtaggattaggaagtagctttcacatttatctttattttttgcaaatacctatgcatatacatagattttcaactatgttttcataggatttaatggaaattgtcaaaaatgtctcaagatagttatgatttttaaatgttatgtttagaattactgatcaatttatgatcaaaactgcaaacagtaattgtaaatattttgaagttggtgctactgtatttttccccactatttgctactctgattcttaaatttaatggactcatgttgaagacaaagtatttacagttataaacacataatacatttagaattgtcaatggaagcttgactttttctcacaggatggttcattgtggttaagacttcattagcatcagtaatgtgtaggaaacttaacctctcattttcaaatgaaaagtgttcagaatttttcaactattaggctgtttgagttatctgtgctagacatttcttgtgatatttttgtcatttagtttttatctgtttttaatatcaagggaaagtgaatgctaggtcaacgtattttgaataaaattatagacaaaaccttttgagtaataattatgtagtaggatgcaaactgacacataatggcaacattcgcaaaacattttattagagattttttcctaagaggacatgaaattttggcattatttttattctgctatatttgtcattagatatgtagacagtttcatgcctgctcatttaaaatgtatgagaatctgtagcagtgtcactggtccctgggaaataaatgatgtcattaaaataacattaggactttgagcttcttaaacccagaattattatctttaagtgaggacagctgcatggcagaaaatgttgatgagtctcttagtgcttaattcaagtgttgtgtgatggttttcctgtacaaatctacactatattgatagtacctgagagggaagaaaacaaataagcaagttcaagcttatgaactactacatttctccacacttaagtgtgtcttatttcttacctcaatcaaatattagttggctcagaataaaacttttttttaaaaaaagctaaaattatctctttgctttgcttgttcttgtggtactactgtttcaaaaagtcattatttagtgataaatatatttgtgttcagggctgttattttaagttagaagagtagaatatgtagttctttttatcaaataatcccagtccttaacttcttaattttgatcaatttctgtttgggtagtgaatatatttggagtatttttgcacactggagaatcatcctgtcacctccacacatggaataacataggtaggtataacactctggtccatttctgggcagttgctttgctttatattatatatttttgatgatctaatgcttgtaatacagtaagtcctcacttaacatagttaataggatcttggaaactgcaactttaagtcataccacaaaattggttttgacatataacaaaaccagttttaccataagctaattgatataaacaacagttaagttcctgctgcatatttctggtgtacaaaacatcaccaaacttctaaataaataccaaagctcttctaatattaaacattgaagtaaagtgttatctgtatatacatttaagatagactaataaaaacaagtaaggtaattgtttatttcatttttggtgaatgagtgagcgacagtgattgtttgtattggtggtgagtttaatccaggaatgaaggtttgcaaagtgaaaattgtcagggacgcttcctaccaccacacagttaacaattacaaatatggtgagctaaccgagagcttctgtaccacataagtttattgttgagcatgtgtatgattatcatatactttatgaagttttgctttacaataatttgtatttattaattcactttccaactctctcactgtagttcagggttgcaggtggccagatcctatttcaggagctcatggggcaaggcagcacctaaccgtggacaggatacccttccatcatagggcacactcacccacatacccacactcactcaggctggaacaatgtagacatgccaacaaaactaacatgcacatctaagggatgtgagagaaaacaagaatatccagagaaaaaccatgcagacatggagagaacatgccaacaccacatagacagcgaccccagctggaaatcagtgtttttcccccattaacatcataacgaaataattttttttaatttttattttattattattatactttaagttttagggtacatgtgcacaatgtgcaggttagttacatatgtatacatgtgccatgctggtgtgctgcacctattaactcttcatttagcattaggtatatctcctaatgctatccctccctgctctccccaccccacagagtgtgatgttccccttcctgtgtccatgtgttctcattgttcaactcccacctatgagtgagaacatgaagtgtttggttttttgtccttgcgatagtttactgagaatgatgatttccaatttcatccatgtccctacaaaggatatgaactcatcattttttatggctgcataatattccatggtgtacatgtgccacattttcttaatcaagtctatcattgttggacatttgggttggttccaagtctttgctattgtgaatagtgcctcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatatcactgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttctttgtagattctggatattagccctttgtcagatgagtaggttgtgagaattttctcccattttgtaggttgcctgttcactctgttggtagtttcttttgctgtgcagaagctctttagtttaattagatcccatttgtcaattatggcttttgttgccattgcttttggtgttttagacatgaagtccttgcccatgcctatgtcctgaatggtaatgcctaggttttcttctagggtttttatggttttaggtctaatgtttaagtctttattccatcttgaattaatttttgtataaggtgtaaagaagagatccagtttcagctttctacatatggctagccagttttcccagcaccatttattaaatagggaatcctttccccatttcttgtttttgtcaggtttgtcaaagatcagatggttgtagatatgcggtgttatttctaagggctctgttctgttccattgatttatatctctgttttggtaccagtaccatgctgttttggttactgtagtcttgtagtatagtttgaagtcaggtagcgtgatgcctccaggtttgttcttttggcttaggattgacttggcaatgtgggctcttttttggttccatatgaactttaaagtagttttttccaattctgtgaagaaagtcattggtagctttatggggatggcattgaatctataaattaccttgggcagcatggccattttcatgatattgattcttcttacccatgagcatggaatgttcttccatttctttgtatcctcttttatttccttgagcagtggtttgtagttctccttgaagaggtccttcatgtcccttgtaaattggattcctaggtattatattctctttgaagcaattgtgaatgggagttcactcatgatttggctctctatttgtctgttattggtgtgtaagaatgcttgtgatttttgtacattgattttgtatcctgagactttgctgaagttgcttatcagcttaaggagattttgggctgagacgatggggttttctatatatacaatcatgtcatctgcaaacagggacaatttgacgtcctcttttcctaattgaataccctttatttccttcttctgcctaatttccctggccagaacttccaacactatgttgaataggagtggtgagggagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtctttggttctgtttatatgctggattacatttatcgatttgtgtatattgaaccagccttgcatcccagggatgaagcccacttgatcatagtggataagctttttgatgtgctgctggattcggtttgtcagtattttactgaggatttttgcatcaatgttcatcaaggatattggtctaaaattctctttcttggttgtgtctctgccaggctttggtatcaggatgatgctggcctcataaaatgagttagggaggattccctctttttctattgattggaatagtttcagaaggaatgttaccagttcctccttgtacctctggtagaattcggctgtgaatccatctggtcctggactccttttggttggtaagctattgattattgccacaatttcagagaacgccacaaagatactcctcgagaagagcaactccaagacacatgattgtcagattcaccaaagttgaaatgaaggagaaaatgttaagggcagccagagagaaaggtcgggttacccacaaagggaagcccatcagactaacagcggatctctaggcagaacctctacaagccagaagagagtgggggacaatattcaacattcttaaaggaaagaattttcaacccagaatttcatatccagccaaactaagcttcataagcgaaggagaaataaaatactttacagacaagcaaatgttgagagattttgtcaccaccaggcctgccctaaaagagctcctgaaggaagcactaatcatggaaaggaacaaccagtaccagctgccgcaaaatcatgccaaaatgtaaagaccatcgagactaggaagaaactgcatcaactaatgagcaaaacaaccagctaacatcataatgacaggttcaaattcacacataacaatattaactttaaatgtaaatggactaaatgctccaattaaaagacacagactggcaaattggatagagtcaatacccatcagtgtgctatattcaggaaacccatctcacatgcagagacgcacataggctcaaaataaaaggatggaggaagatctaccaagcaaatggaaaacaaaaaaaggcaggggttgcaatcctcatctctgataaaacagagtttaaaccaacaaagatcaaaagagacaaagaaggccattacataatggtaaagggatcaattaaacaagaagagctaactatcctgaatatatatgcacccaatacaggagcacccagtttcataaagcaagtcctgagtgacctacaaagagacttagactcccacacaataataatgggagactttaacaccccactgtcaacattagacagatcaacgagacagaaagttaacaaggatacccaggaattgagctcagctctgcaccaagaggacctaatagacatctacagaactctccaccccaaatcaacagaatatacatttttttcagcaccacaccacacctattccaaaattgaccacatagttggaagtaaagctctcctcagcaaacgtaaaagaacagaaattataacaaactgtctctcagaccacagtgcaatcaaactagaactcaggattaagagactcactcaaaaccgcacaactacgtggaaactgaacaacctgctcctgaatgactactgggtacataacgaaatgaaggcagaaataaagatgttctttgaaaccaacgagaacgaagacacaacataccagaatctctgggacacattcaaagcagtgtgtagagggaaatttatagcactaaatgcccacaagagaaagcaggaaagatccaaaactgacaccctaacatcacaattaaaataattagaaaagcaagagcgaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccagcgatcccacagaaatacaaactaccaacagagaatactacaaacaactacacaaataaactagaaaatctagaagaaatggataaattcctcgacacatacaccctcccaggactaaaccaggaagaagttgaatctctgaatagaccactataacaaaataatgttattcaaagttcatctgacatgctttttcatttattcttcgtacggtataggaagaataagtatatgctttttatgatatacttaggtcttttctcaggttaggaaactcttcttcaagtaaggctttgataattgtttcactgcaaagattgctgccttattttttagatttggatgtctgttgtctgcattcaacatcaatcataagaggacccttcatcattttcaccttgtgtgttttagatagctcaagtagtttctatataacactcctcatatattgctttggatacattctgtttcttaatgtttccaatgggtgttattttttctgctgttgcagttagagcttccttaaatcctacttctttacatttaaaaaacaattataagggggctgccaagtaactttccaaaattttctcttagctcctattgaaagctattttcaaagataactgttccccaagactttatgttgtttctgctttttcttttctttccagagtttttggatttttatgtgagatttttgtgtacatttagattgcagtgagaaaagcccattccaaaccccatgtttttcaaaagagagggtctatggagaacccttgggcactctctgcatccaattggatgctggtcaaatttctgtctcatatcaatagctgcaatagatggatatgagtagcccagagctcagtttaaaagcaccaagctgacattcatctcgtgtgaccctgctggtttgagatgaacccataaaatccataaaattaaaaatctcaataatcatagcccctaggaatctaagaattgtttatttcctgttgtgcctatagtgttgaatttgcaggaatgacttattgtagaacagaatatgtttcattttctgtaccatcccctattatccaccccacacactcaccagcaacatatggtcttcctttccagtgttttctctgaaacttcagttctgaacagatatgctaagatggataagcagtgatggggctgaaggagagcgatgctttaactgcactttgtgttcaaggagtggaatattcagacatgttagactgagtattaaatgttcaccaagtcacttcaacctcatccttcatttttaattttcttcatacattactgtcagaaattattctgtttaattatagattggtgcaaaagtaattgaggtttttgccatcaccttcaatggcaaaacctgcaattacttttgcacccaagtaatattttattataaaccacagcacatagtgcattctcaacaaatgttgctgttgggatgcaggaatggatggatgaatagatgaatgggtggctggctggctgaatggattggtggatggatgggtagttgttcaggattctcattggtatgggatttgtgctgttagtctgtgtgtcctgcagactaacggcacaaagaaagatagaaggtcttgctacctgctctcagactggtataactcacattatttggcaatacagagactctcagtcttagtttttattgggagtgtaaattttgcctctttgctatgccttcgtagacattttggtggaaagtggtgacagacagtgtcacaggctgccaaccaggtaccactttaaccaccaagactctgataatgtctcgtttcctcctcccatctctaccccttgcttcctctcagactcctcctactctctgtctctccagccatgcctccacttgcagaatatccttctctctacccaccgttcatctttaccctggtcatttctttagccacgtcctcatgcgtatccagcatttctatcctgctgtgtcaaatataagacacattctttaactttagagggaatttatattttctcgtctgtagttttctggaaatagtggggaggttgtaggctgtgatcaatttgggagccatttaatggcagtaaaatgggcaaagcaatatatcgagaattcttcaaattgatatttatctattttcatccagccttaggtattttaatacagatacaacttttactaccagcaaactatagttagtaattgattttttgcttcctatttcaaaagctacagataaaaggacattaatttttaagaggccactcaatcagaaaatgcattcttcacttagagtggtcaaaagagcagtggagtggaactcaggaaaccagaggactagctctgactctgccacttacattgtttgaagcaaggtatttctgttagggacctccatgggccttcactctaaccaacttttctgtcaccttcatgtactaagagtctctgatcccgtgaggatgacgtctacttgcccatcactgctcctacctgaaacccaaatgtgccgaagtttggatcccagcacaggctcagcatcatcatggatgatcagctcatagtcctagaactggctgtggagacttttctgaatatgaacattgtttttaaatcagtgttagtaaacatggactcaatatttacttgaaaagaattatttcagttacagattgatgtagttcattttaaccaccttgtgtatgaaggatgaaaaatgagtgatctagttttgaagtaactacaaaaattgtgtttgtatcaactgtcctgtttatttttgcttgtcataatgagaggacatcattattaaatctaaattatctccaccacagtgtcactaaatatgatcagtcaactatctctgcttcctttacttgagatctgttgaactaaggtcaaactgagctcaagcttctcatccagattatggcaatacacacctttccccaccaattgttctttaaagcattgtgagttggcttagcaatgtcttcttccatctaaaggtgggtcacagcactggcaaatgtataatgttggactattgctgggagccacataccgcattagatttttttttttttttggtacgctaacagctcctcattttctggcaatgtatgacaggcagaactgtaatagttatcctcataagcaatgtgcaagttagataattgcaatactaaacacaatgaatattcagtttgtttaggggcactgcagtgaaaaaaagaaatgcatgtagttgtgatctacctgtctcaccaaaactcacatttagtctttcctaaaaatacctgaacttcattaacatcaacttcaccagtactctttcagatgactgcatattgaattaggctgaagggaaggggaacagtagcccatggggtcatatcagacttgtaattctgctctttccaaaagacttacagtgacagccaaccacattccaagaactgcactggtcaccagagatgcaggaggaatgggccatcatttctgtgcccaaggagctcacacagactgtaattacctctgggaatctcaaagaccaaagcaatgtgaaattttgtccacattgttctcaatagtgactgagctattctatatttgttccctgatctgttttaagaatgaaaatatagagaaattagagttcaggtgagaagagttaaagtgattaagaggatggtgaactcttctaacaagaaactaatagcgtgtagcttagttcaacagtggtaagtggagctcatgataatgatatataaatgtttgaaaaatataaacaagaaggggcaacattgtttagtattattcaattacaagtgattaatagcaatgcaaagtaattatgaaagggaaattaaaaatggacataaggaaaaaaagttttcttttggtcttgtttcctaaaagaaaatatagggctacattataggaaagcatttgcaactacacaagaaaatatgaaacaagcaagctaagagcaagtaatttaccaatggtagactaattattttattaattcattattaataaaatttattaattcatttatcaaatgtttttattcattcatttatcaaattaattattcatcaaatgttttaggttactcacctatttaacattttctttgctcccatgtattcatgtatttcatttgattatttttttttttaacatttcagtgttccaaaaattgggagacataggcagtaatatattttttaggaaaatactggtggttgtaataaataatctgatatttcagtagtccaacacattaaaagtttggttctcattcatataaagtccaaatcaagtgtttattaaaggcagaaggatgagggttggattgtgggagtcgatggttggaggggcccagatccatgtaatcattcagagatccgggctgaggaagatccataaattcactgtgatctccacagccagctggaagataagagcagaaagagactgaggaagaagtaactcctccttacacactcggttccagaagacactcagatcagtttcacctatattccattgttgagaattcatggaatgacattgcttggatgcactgggcattgggaaatgtggcttctttcctagcatcatctctacaactttcaggagagcatgagtttttaatggacaaacaggtgaataaaacacactcaaattcctggcctcttggaaaatacattttagttggaggaaactgatagtaatactataaaatcataagtgaaataaacattttttttgtaaggacataaacattgtgatggtatgtaaagcctggaagaagtgcagggagtgttgggtgtgcaattttaaatggatagtttggaaggagctcagtggaaaagaggtatttgagcaattatttgaatgaggtgagaatgtaaatcatgtggaatgtaacgggaaattatttaaagctgcagcgcagcaaatggaaagctcatggggtggaatcatgtctgatatctttagggaacagctggtggctaacctattaggagcaaagtaagcaaaggttagagaatggtaggatatgaggtcggagaagtaatagggttctaaacatacagaggccttaagagtgacagtgagaattttggctcttactctgaggtacaggggaagtcattagagggtattgtacagaggagtgaagtgatttgatttatgttttaaaaggattactctagttgttgttctgaaaatagactgtggtgcagtaaggcagaaggagggagaccattagaaagctttttcaataattgaggtgagaaatgatgacagcttagaccagagatattgagaagtggctggattctgggtatattttgaaggtggaagtgacaggatttgctcatggcttagtggtaaggtgtgatggaggaaaggagtcaaggatgactcgaagactttgtgcataaaagactaagtggaagagtaggatttttattaattgagatggggaggactgtacaggattctcatttagatgtgggtggagcacataagggtcttgatttggaatgacttttagatatttaagttgagctgacaagtaggcagttagatatatgaatatggtattggcatggggaatggaggaatagatccaaatattgagctccaagggactccaatatttagaggctggagaagtggggaggaaccagcaaaggggaatgaaaacgagtgacaagagaaagaaaatcagaaaagtctagtattgagaaagccaaggaagagaagtgtttgaattaagaaagaatgaggctgagccaggaggatctcttgagcccacgagttagagaccagcctaggaaatacagtgacaccccagatctataaaaaaaaatagccaggtgtggtggtgtgtgcctgtagtcccagctactaaggaggctgaggcaggaggattgcttgaacatgtgaaatataacgggaagttcaaggttacagtgagctagatcataccagcacactctagcctgggtgacagcacaagactctgtctctcttaaaacaaatcaaagaaagaaagaaaggaaagaagggaaaagaagaaagaaaagaaaggaaaagaacagaaaagaaaagcaaaaaggaaggaaaaaagagccacagtctcagctgctgctgacaggtcaaataaaatgaaatagagaggtcattggtgatcttgatgaaaaaagaaaaaagaagccgagcgcggtggctcactcctgtaatcccagcactttgggaggccgaggcgagcagatcgaggtcaggagatcgagacaatcctggctaacacagtgaaaacccatctctactaaaaatacaaaaaaaatagccaggcatggtgacaggcgcctgtaatctcagctactcgggaggctgaggcaggagaatggcctgaacccagaaggcagagtttgcagtgaaccaagattgcaccactgccctccagcctgggcgacagagtgagactccgtctcaaaaaaaaaaaaaaaagaacaacaacaaaaaacagttttagtgtagtgatgagcaaaaactgactggagtgaggtaaagagaaaatggaaaaaggcaaattggtggtaattatttaatttttttatctaattgttttgaggattttttctataaaaggagcaaagagcaaagtgatagggtgataattagaataggaagtagacacaaggaagggatttcaaaatgggaaaaatgacagcacatttgtaaagcgatgaaaaatttacaatgcaagaaagagaaggggagttaatatgcaacaatcttatgtcgatgagaagggctggaacaggcactctagtgaagggactggagataaaggcaggtttatctgtaatggttcagattaaggagtgaaatgcatggtaggcttgtgtgagttccctttgaatttctccttttgttcttaggaaataagaagcacaggtcattcagaggagaagatgtgaaatcattctttaagggaataggatagtgaatggaaaacggaaatcttcccaggcagtttcgaagaccacttgaggctaatggtcatgtgtggaaagcaaaatcattcaaccttgtgccttttaaaaaattttgtcccatcatagtacctgtgtgggagtgtgactatagcataatggagaattttgtttagcgagttagacattttttcttggtcagtacaatggcatgagagatggttaaggagtttaatacttgagcaagagaattattaaaacagcatgctggagattctaagcttggtcaggtgggtgtgatgactttaaagagttgaatatggtagtaaaatggtgaaaggattagtgtatttgaaaaaaaaaattagtgttatgctactgaaaggaatgccataggctcactctgataggaatctttgaagctaaaaggatggagtggttagttgttggtaatgagaagatttagatacaattatagaagtgaggggctaaagatgattgcagaataaagccacaggaaatcaaagaatggagaggctgaagtattggaaggatcgtcaaacttgtttaaatctgagaattttgacaggaacagtgtagatgtgacacagagccaggaactacagtcttacagctatgacattccatctgggatttttcaagtatctcattgaaattttcttttttaacagtctagttggggttagctctgagtttttgtttaaatagaaatgtttttattttgactgtagctttcaaagatgcttttctggctagaattccaggttaacaattatgttctcttagcattttcgaaatattgttccattgctttctgacttttgtgtttgctattgagaagccagtagtctaattattgtttattgtggatgactttttttcccacagctgttttttaaaacttctatttatttttacactgcaatttcagtaggatttatctacgtgtagaattcacaaccttctgattctgatcattgttatctctcattaattctggaaaattcccatgaatttttactccaaataatcattgtctttattttctattaggattttgcactttatactgcttgttggatctttccactctattatcctttccttaaaatatttctttcctattttccatcaccccttatatgtgtacttcatttcttgtattttcttcagatattttttcaatgtactaattttcctttaagccatatctgatagtctttttaacgttacatttttcatttctatagagttatttggttctttatcaaatacgtatgtataattttgttagttcttttttcctaactcctactccaatttctgttatttatttaaacatgttacacatgcatgatttatagtctctgtgtcataagtccaatatctgttgttctttggtgtttaattctgtggtatgttggttctgcctacacgtatacatggcagcttatttcctcatttgtataataattttttaaattcttttgatctttgatcctttgaaattgttggggtaatttttaggctacatttaaattgtcttcagaaaggatttctaggctactttcagataactagaggccttagcaatctataactactttaaattatactttaagtttgggtggggagtggacaagggtatgataaattttgtttcaaacatgagggcaaatttttgtttaagaattatcaagagagttctccttctccttcactgcctcctcttcgtccttcttcgtatctactttaggccaaagctaggaccttcattctaaatgagttaccatgtatcagggattcaagatactcacagggagtcttcaatctggccttctaccttagttccttatttgcatggccgactaaaactcagactccgggccaccagtgattggcatataaactgaagaaaacttcccattctagtgcttgcttactcatgtggattctctctttctttcctttcttttttttttttttctttgtaaagccttctaaagaattcccttactctcctgtgactacagtcgtgcattaaaaaccgattatttgatatgttatattattaattgtgctaaatgggaaataaggggtgtcatgttctggtaacatttactcaaacttttatatatacaagtctcattgggtgcttcatctttgtgttttctcttttttccagggctctatgtatattaaggatagcaattctaggccatacatagcaagttatttttttccctagtttgttatatctagttttaactttgataaaagtgctgtgtttttcttcttaagaccttttaagtttttatatagtcaaatatattgatctttccttttaagttctctgcatttgattccatgcttagaaaattgtctccgtcgataccataaaattattttttaatctgatatttcttctagttcttcctagaattaatattttcaacgacccgtttcatctgtagaatataaatgactccttttatgtggtgcagaatgcttttatgtataggtatgccttcaactttctattatattctatctatataatatatatttataaatatactttttctagaaaaaattagcttaatttaggtcatattgagtagttccatcacaagtttttttattttgatttttttcccttctccttcctttagtcatctcacaagtttttggtgttttttcctaaggaaacatggaaggtcattctactttgcctcaggccttgagaacaaaaatgaaaaagttggacacatcaaaaccctaaatctaggcactacagacaactgaagaggcagttcttatttagggtgatatattctttaatagaagatactctgcttgccatgggaacgtatataggaggtgcgtctgacctggacaatacaatcaggaaaagcttcctggcaggggtgatttgaagtctgtatttccagtatgtggggaatggtggagaaggagcaagaaagtcatgccgaggcaacatgtgggacgtttccagtgagacaaagcagaattatttgaaaaactaaaacagtagttcagttggggagaggtatacattgtgatgtgcaaatgctgcagaatgaagccggacaggaacaagggccaagcaatgaattgtggatgttttattgagagcaatgagatgcattgaaaggtttgaaactgtggaataatgtgatcaaatctgtattttttgaacaacatctaggctgtagcactttttatactggatagaaaatgacaaaacccttagagggatgggctgatttagaggatattgctgtaatgtaggtggaaagtaactatggcctagtaaatgtggaaggacacagatacactcagtagatatttcagggtgaatggccagattaggtaatgactaagatagcaaggatgggagaaaaagaagaatcaaggaggtgactaagcttttttcttgagcaactggtagattgagttaacattttctgaaaaacgtgatagaaggaggagctgtttctaggagggaaataaataatttggcaggagactttttgaactagatatctattgaataacaaagtgacaatgttccccatcctctcatttccattcccaattttacttctcgtcccaattcaaatcattcttacttatgatcggcgctatgtcagtgcctctcagctggtcttcccagacccagtacacctaatcaatccatcctacaccaggatggattcttcgctttccatacttgtggctttgtttattctgtcccctcccctgggagacccttctgcctacatatcttaaagcctatctacaaggacaccttcatgtcctaggtaccaccagtggcttctgatatgttcccttgatgatcagccataacattgtatttgaatatgttgtaacttagtatagaaatcatgggtactggacacaggcaaaaccacctctgccacttgcacggccctggaccccaaggaaatcaactgctctaaacttctgtttcctcctttaaaaatgggtgtaataataaagaccttgtttgttgtgaaggatacaattaagattggcacaatatctgactcccccacacaggaatttcatttcataaatggtaattattactcatattgtctacaaagccatttctcacagtctgttgctatagtagtcacttacgtgtctgtatctccttatatgaaggcatgagcatttcctttattgtcttcacaacaattaataaggacaagcacaatgtaggtacacaatatatggcatgcatgaatgtttaaataatgagagttactaggaggatagagaattacagaaaaaagacttgcttaaactgaaatatttcttactgtgtgccataaagtgctgaggggtgctgtcttctaccatgaatccttccagcctgaactgcaatgattttaaattttttgacagttctgttctccctaagagtagtaattttggtggttatgcatagatcaaagatgcaatagggaacgttttaagtgatgttgtaaataatgatttcaagaatgtgctttaatttttattgaatatcatctgattagcaatcttgtttttgttttagccttgtgaatatttattctagcataaatgagtacagtaatttctaatgcaaatattgtccacctgggtttcctgatgtctgtatggataattcaccttgttctttgttagtggaattattggtgcctctcaggttggaagatgcctgtactgacctacctgtggccagtagaaggtgggaagacctgcatattgcctctactcaacctctttctcccagtaactaagaagcctggactgggctggttggtgcggttcgctctttctgactctggttgtctcattcatgccagttcgggtgacacttgtgagaggaaggagttcagtctttgaggtcaggcctgtctggctcccaggcccaccactgccacttcctatgtttgcaatctggaaatagctccatatgttttttgaacccaagttgtattgttttggtttggtttcagtgtatgtaggtatgtgataatctttggtggcttacgtctgtaatgccagcactttgggaggcagaggcgggtggatcacgaggtcaggagttcaagaccagcctagccaatatggtgaaaccctgtctctactaaaagtacaaaaattagccgggcgtggtggcgggtgcctgtaatcccaactacttgggaggctgaggcagaagaatcccttcagctcaggaggcggaggttgcggtgagccaagactgcgccactgctctccagcctgggcaacagagcaagattttccctctcaaacaaaacaaaacaaaacagaaaaacaataattttaaaacaggtagggtgacccccatttactccttggagatctagttgaatttatattgttcttccaattctcaggtctgcagaatttaaaactctccccaaggtttttacagagtttccaccttggatgttctcctggtcccctctacctccagctcccgtgctgtggtcattgctgcccttcaacccatatccgtcataataagaaacttgggctttctaccagtttccttttaaaaatccacttgcatgtgtttgtagagtgagctcagtgaatgctggggtatcatgatggagtcacactgcctttaggtctttacttggatttctgttttccccctcttctcccatttctggattaagccttctctccataactgctctcttccctccttcaccttttttctgtctgtctccctcctttccttctgttctcttctttctgtcagtgtccctttctctctctctctctctctcacacacacaaacacacacacacacacacatacatctcttaaaaggatagtgatactttaccagttgatttacaaaaatttaaaagcaattatatatagaaattagtcagtgagctgcatggtgcaaatctatattggtctttccttttctttgcttttgatgaccaaagaatagctatccaaagatagctttgggttgcagctgctgccaggtatcatgcagtctggacattgggcacaatgtgtcagcagaactgggggtgatccaagcagcccgggaaacaaagccctgcttgtatctctagagtgttctttcccctgaagaggcccaaggtccctgagagctcagcatagctcatttctttattatctgccacagtcttcagtctcctctggatgccagaggggagcagattggatttctgggagagtcaacaaatagaagttctaagaattaaggcaggccgggcatggtggctcacacctgtaatcccagcagtttgggaggccaaggcaggtggatcacctgaggttaggagtttgagagcagcctggccaacatggtgaaaccccatctctactaaaaatacaaaaattagctgtgcatggtggtgtgcgcctgtagtcccagctactcaggaggctgaggcaggagaattgctctaacctggaaggcagaggttgcagtgagccaaggtcacgctactgcagtccagcctaggggcagagcaagactccatctcaaaaaaaaaagaaaaagaaaaaaaataagaattaagggaaagctggctcccaggcaatgggatggagcagaatataggggcatgagatggagaggctatgctgtctttctcccttttgatgatgctactggggaaaagtatcatcatcaaaatgtggaagggaaaccaaaaatgaagggaaggtactgaagagaaacaaaaatgtgctgaatccactcttaggaaaatgactggtctttttccttgctgtgtattcagagcatacctactgctagagctactgaatctgtgcttctggagtggtttggccatttgcagctccctcatttgaggactaatattgccattctgctgttctaagcagccattatctgccgcccaccccaccaacttgataccccattagtgttagggtacataacagtacctcagccaaggacttgagtacctccaggcaagtcactcactcaacattgtggtgtcttcttcagtgatagaatggaatacctgggcaatcccaggagtcccctccacctcaaacaattcagttcttctgtggttctacacttatgattcttttgatgagagtattcatggctgttttctcatttttatgtcactaactatcactggaaatgcattttaggtttatcatcattttacagtctcaagtttctgtttttttttctttattttataccaagacgcaaatgtgaaaaaaaaaaggaaatagaagtattacaaatatcttagcttataatagcagaccaaaagtaattggaagaaacatgagatgagaaagtataaacatatttttaacataactctgctgttctactgataaacaatttctgctgctctatttgtatagagacaatcaatatattttttagaggcaggaaaagatctttttttttttgtcagatgaaatgttgctttctaaggatagtcaatcggtgcccttaataaacccatcagcccttgtgtcttggtatagcattattggtagaggtaattatagaagctaatatttggtaactaaagaaagaaaactaaagaaactaaagaaagaaactaagctaaagaaaggaactaaagaactaaagaaaggaactaaatagctgaagaaagaactaaagaactaaagaaagaaagtaaactgggaactaaagaaagaaaaatgatgtattcaaagggagagcaagtccctcccaccatcgtttgatctatcaggtgtgatttgcctgctggcttacatcatggaaattttacttccattttttaacaacatagctgggagaacaaagaatctcaaaaacgttttagttgtagagagggtttactgccctgatgaatgactgatctgtatttctgaaaggaatcttctgcctcttatcatgatccagtcttgtattttttctcatggtgacagtgatgttgtacctcatgtcaacatgaaacataatttttcccaaacaaacttttaaagatagggaaacaacattgacatgttctggtttggaattgtatcagtgaattaaggaatggatttaaggaaagatcattagaccaagagtcaaaataactctgtggtccaatcctgcatagcttatagtcctgagatcacaggaaattcacctaagacaggatcattctagtaccatggagatttgcctggtccacctcacagggctctcatggagatccatttaagtgaaatatactaactaaaggtaatcattttcttatgaaatatcaaatatatataaaaataatatatttattataaaacaataaaaatcccattcactaatcattattgaatacacattttaaataatcatttgctgaacaaatataaagaaagcatgaagcctaggagatggtggaaaaatgacttatacgcgttgaaaaaaaaagcatcaagatgtcaatagatttgagtagctaactaaattagatataatctttgatggataaatgtaaagctatagacggacgatcaaggagtaatgcatgaagatgagatggcctgatgcacacttatgagcatttaagtacaagagaaatctgagccaagagaatgccccaaaagttcctgaagttctggtaagtgctgatggaaggggtgacccacagcctccacctggagtttagacatcccctttagctgaacattgtcctctcctgaaagtttgctgaatagtgaatttggagatagcaagaacctttatctctgtatttttaatggaagaagaattattcaaaactccaaccaaagtcctcagtatgttgaagatactcttaaatacccatataacaactattcatgcacacataaagaatttcatacatccattgccctgttatttaacacttaaacttgttctttgaaatatttgtgtgcagaagctgagcagtatcagagacaaattaaattttcatttcataacaaacatctatctcaatatactttatcattccaacttttcttctaaaataatggattttcaaggcctttaaaactcactgactttcttcaaaggctttttgacttccgtaggagacatatttacgtaaaactatgaggggaattgagagtgataatgaaaaatccatctattaatagcaagcacaagcaggagatgcttgttattagaataaaaacacatagacaattgcagaacactctgcttcctctcaccaggtctggcctgcaattagacattttcactgatgtgtataaatagagtggggtttagagtttgataataacttttaggtaaaatttattgtatatcattgtagcaaacattcgtagaatgagagtacatatagtgaaagatatatacattgtgtcagtttgtgtcactgggaaggattcactatctgccttcttaatgtgacacagtaattcaattaattgtgtaggactccagtccctggcacatagtacatgttaaaaaaaaatttgctgaattactgacagaagggggaagaatatagactactgcattggggttatcagtagagagtacataaagaaaaatgtttttaataattaaaaattctagttagaaaataaaaaaggagatagtgtgttctgtgtctctagatggacccttgcaggaggaggaatattttaggaatttcgctgaacagattcatccctagttggatttttagatgcaataaccagaaaagatcctcccaccaatccaaagtctctgattatctgttcaagaatttgtatatcccaactctttgtgtagttaaaaattataaatcaaattgctctttaatctagtttttatgtcaggaacaaaactcacatttcaatttagaaattttgcaaaggcctgttttccattgctatcatcatttttattattgtcttaacctttacttttaaaaatctatcattttaacattataatcattagaagaaatgaacgtgaactaaaatgtatgtattttgtttcatttttaatttaaccatgtcttttacaagttaatgaggatattaatttttcaaatataatttttagtttctttattttgcctaaaatctaaaaataactaccatataaaacaaatattatcttgttcactcatcttgggaatattcttagtacaagaatgtgtttatgatttaattgatgaagaatgtaaatatacatctacacatattcatatgtattaattttcatgtattatatatgcataaattaccttttcaatgtacatatgtgcatatattttgtgtaaatgtacactctgtctatcagtaaatttgtagacatgcctatgggatttgcaatctagttaagttatttcttactgttacgtacttttctgttttacttatggttaactgatgcagggaaggcagaggcaagggaccctcattttggtatcctatttgggggcctctgcaatatgtgctttctggagcctggaccatgcatactaagctttgtggactatcagaggtcctacaagcacacaatatttaaaattctataagatccatgtctgctgagtacttacctgagtgattcacttcacgaagacctgaaggaagtcaatgcaacatttatgtttccattctctctacaccagtgagtataatgttcttaggaccagtaaacattgggatcagccatatgttgggaagacaccagctagttcaccacccatggtacttagacctattcttttttttttgagtcatgattaatgaatcctatcatactggctgtcagaattctttggattcaatttgtagatacccttgtccatagactcattaagacaattttcatattagtgtgaatcaacatatataagtaacttgagtaactcctcccaagaatgcccttctacttttagctattagatcctaaatatacaaaagttaagaggctttatagaatacaactgcaaattttatttcttactatattctgttgaatttttctcagtttgattttttttaaaaaatggcaaatataacaaaccccaaaacagtggagcacttctatttcattgtcaaacccaattgacaaaaatttgaagttagtggaatttttttgaaggaaaatttatccttgaagtcatcaactattgtaattcatgctttagaaaaacaagcattaggactgaattgtattttcttttaaattcatttatgttaattattgtaaagaaattttcccactctacttttgttccccatttgctgtttgttgttgtcgtggtttgtttgcttgctttggagacagagccttgctctatcccccaggcgcaatcttgcccactgcaaccttctctccccggttcaagccattctcctgcctcagcctcccaagtagctgagattacaggttcctgccaccatgtctggctaatttttatatttttagtagagacgggttttcgccatgttggccaggctggtctcaaactgctgacctcaggtgatccgcctgccttggcctcccaaagtgttgggattataggtgtgagccaccacacctggcctgtctgtttgcactcctgctgacagcaccagtggattgctattgtgtttttcagagaggaaccaccaaatcagaactgttagacctcaaacagttgtttttgacacagagtggtggaagggagccactcaagaaaccttgctttattatcttaatgctctcaaagcaatctttgtcatttcctttgaatagcactttgcgagtttcacttgacatatggcatggccctcagggatataggcatttgcttttcagtctaaacaaaaatcaagtttataatttttatttttgtaacaatttatgtcagtattcatcacagaaaagcatattcctctttttccttctgacttacattcctcctcaagctacctgtaagtaatgatcttgaacagtacacaactgacaagtgtttcctgcgtcgaagaatggttgagtgtgtgagtgtagaacaatagaattatagtttataaatactgggatttcaggactaatgtaataaggagaaaccatccttcctttttatagctttgagggaattgcaggaacaactactgcagcttacagtagaacataactgtttagaatgccttttaacaattagtatttagtgtctcactttatttctaaggccactgcacgtgatacagaagcctgatgacagtagcatccacattcttttaaaaatgtgtaaaataaggttataaatgtttacttttacaaaaattcattgattccctcctttattcaataaaatgtatcaagcacatactacatgataggctctgtattaggtacccatgtgcaaaatagacgtttcctgcccttgagaagcgtacagcttagttgagaaatttactagtcacataaaaccacaaataaatgtataaggtaagctgtgatactgctattatgaagaggcacaggatgctgtaagaacacataaataggggtttcaatgaaggcttgcttaaggtgttaatattagaattgagctgtaaaggatgaaaatgaattgcttagatgaaagaggtgacaccagagggagcgggcagggaaagggggagagtgttccaggaatgcagagagacagtgggaagaaatgaggtcatttaagtggccaagccaggtcaagctgggcttgttagtcactaacatattttgttttttatcctcagactataaagtatggaatgaaataatcgtatttgtgtacttaaaaatcactctggatgctatgaaaatataatgacattgagtactgctttcaataagtcacagtggaatcttgcaaatatttaaaataagtcaaccaccaaaacaagaattgtatttgagttaacagcatgtccacagaagggtttaattggattagagctttgaaaactgtaagtagaaacacaaattgcttcagagaatttataatcctggaatgatatttcccatgcccagagagaaacccattcctcttgttactgtcttcagaaccacagagcatgtcattaaatagcagcttagatggctgtgcaggcctactagggtgcagatggattggataggggtcaggttgcattggagtttcttagaagcttcacttcacctaacgttggcaaaacagctggacctcagagaactgcatgcacgaggtaccagatacacgaaaagaggcaaagcgtgacacagtgaaataacaggtactgatgttgagacttgtgaggtggcgcctggtttctagaccaggaagttttcttactcatctcttcttacaatgggtgaggcaccgggcacacatgagcgtatttaactttccaacagccatgtgaggtatagagtgtcagctcctttttaataagtgagaaaaatgaggtttagagaatttaaatactaatacccaaagtcatacggggcatgaggacaagattcagactcatgtctgccagctccaaaccaggatttatctgagcttatgtcactcatttaaaattggtatttgaattcgtatttatttttgaaggtgttcatacaaagaaaacaaaaagaaacggagtctggattgtagaaaacatataaaacctatatcaaaaatcatctaatagtgatagatagagaagtttcatattgaaataagcttttagaaaactgctctggtaaattaattggtacaaactaagaataaaaatgggatggttagcatagcttgtttgtcacaagaaacagaaacttcacctgcctttttccctgtgaagtgttggtgcagtgacaggattcgcctctcttattaatagtctgtcaaaatccaggaaaatcatgtgatgcttcagagatttttctactgagtgaatatatttgattaaacaccatctgcaaaaatcctcatcacccaagaaaataacagatcgtagatctaacacatgctttacatgtgtcaagaaatatgttggtcaaatcaagagataagcacataggtttatctgaagtccaacttaaaacagctgctttcaaattccttgctaagccaggaagcttgactgatgggacccagagtgatctccctgtctcccctcctagctgtttcttctcacctctgaagttactttttccacattgagggggcctttcatgagtaccagggagaatgagtcaattgagttcatgcaaaaaaagaatcccatcctttcaagaaaggagggagaaaagaggagggaaagaagatatttaaggggttttgctattttatctggcttaagttaaacttgtaatgtcaaaaaataaagtctgaggaaaatatgagtaaattttatctttccttgaggtggatcctttttagtcattggagcaaagtcaaaaactgtaacagaaaatattgataaatttaatataaaaatgttaaatgttattgtgtcagatgaagataaatacaattaaatttaagtgacaaactggaaaaataataatgacattaattacagaataagtatattaggtaaataaaagctcatagtttagtaagaaaaagataaatgataggaaaaaaacgaacaaaggatatgactaggcaggtcacaaaagaagaaataaaaactaccaagaaacatttaaaaacatttcaatcttgttggtgttcaaagccacacagatgaaaacaatatttttgcctatcaaattaatatatttttacaatgtaacccccattgtttatgtaatgaaaaaggcacaactttccttattggcaagttggcaatatgtcacaagtcagtataatgtctaaacttatccagtaatttacctttgtaaaattgttcaaaagaatacttggacatgtatgcagttatttgtgctacataattatttataatggtgaaatatctttaataaatgtaatgtccaccaatagaggattggctacttaatttatgtactctgccccgatagtaccctgtaaactcagtttttaagtctccacaaatttatgttaatttttatcattcattgattcaataactaaatatccattaagtgcctactgagtgtgttgggtacccatgaagacacaggtgatccagcagtgggcaaacagaggaaaattcttgtcatactagagaaccaaatgattcaatgacaatgagtaaagcatgttttgcatcagatggtgaggagtgccattgagaaatgctgagcaaggatggggataatgctagagttaggtggaggaagggacagtgtgattttaaatagggtgttagggaaggcttagtgataaagtgacaagtgattcaaaactcgcctgatatgaggaacagaaacctgctgatatcagagagaagggcatcccaggcagaggaagggcgcaatggaagccttgaggggagagcatgctggatgtgtttgaataacagcagaagggacactgttgctgagcaaagagaaccaatggcagaatagcaggagaagaggttgcagagaatgaagagaaccccataggccattgtgaggatgcgggctttttactcagaaagggatgggaagctgttggagggcttggttgatgaagtgacattattttacttacatttcaacatcatcactctggacactgtgtcaagaattggctgaagggacgctgtggagccaaggagaccatttaagaagctattgtaataatgaaggaaaaagatgttgggaatgtgagctgttgtagtaagggtggagatagtagggaagggtttggttgatatacttgaaaattttatattgtttgaatgtcttaattttatttttaataagcaatatgtttacatgattcaaaagtcaaaattattttaaaagtgcatacacacagtccagtccttctgaatcccattttattaattacctatttgttcttccaatggttctttatatgtatatgtctactcctgtagggtgtgtgtatgtgtgtgtgaataaaggaaggcatcaaatggattatgctagcttttgtctccctttcttacccaaacatgtttgcatatgatataaaactgcacagtacttacttttctcacctaaaaatgtatgattatattttgaatatagagccaacaggactttctgaaagattgcattaaaggtattaagaaggagaaacatgaagtgtgattttaagtcaccggaagaagcgtgttgcctttgggataattgcttgttcagcatctttcttccctgacttaacgggagagaccatagctagatggttcccatctacttcagtaaccagtaaatgttagaagccgcatatttactgttgaataatgagtgattgataggataaatattgtatacataaactaaaagagaattcaagtagcaggataaaatttgttttcatatatatttaatgttttgagaaagtgcttctaggactttggtgaaataaatatttgctctgcttatagaacgtgctgcagatacacagagagtatgttggtatctatactttaaaaatttgctgaaagtacatacacaagaattttaatagtagttatctcttggggttgggattatagatgactttttttttgcttcattattttatgtcttttctgatttatttattataaacacattttttatatttttattttattattattattttttaagagacagggtcttgctccatggcccaagctggagtgcagtggcacaattatggctcactgcagcctccaactcctgggctcaagtgagccttcctcctcagccttctgagtagctgggactacaggcgcacaccactgtgaccagtgaccagttaattttttaattgttttgtagggataggatctcactatgtttcccaggctggtcttgaactcctggtctcaagagatacactcactttgtcctcccaaagtgttggggttacaggcatgagccaccacactgggcctctactgtagacacatctttataaaattaggaagaagtgaaaaaaaaaaataagggatgtgatcccttatgtgaaattttgtttttcctaagttgaaaaatgatagaacaatgtgtaatgtgtacaagtgacaacaaaataaaggagagtttcactacttcttaagataaaccctggagcagactacctgaaaatattaggaaattttcactttagagatgcgtgagatcgggcagccagaaaatgacacagcaaggaaggactcctgtcatttgatgacactcatagtctgtcagggcattaatcagggtatagaaatataacatctgtcacaaattctgtgagatgttcttgctgatttcttctatatacagtgttattttgacattctgtatataaaatatggcactttttatccatgatcagattttcaaaatgatatctgtgccagtgacctacatttttgtctcacttgacaatgacttggggctctttccctattagatcatatagggaatgtctacctcattctcttttttgccattttcatggtacgatttatattatataatagggatgtgctataatttatctggtgtcttccatattggtagacaaatatatttgtcctcattttttactattacttagaacgctgtaattaatgccgcaaatattgctcaaatgtaatttctttacgatagtttcctagtattggaattgttgaattaaatagtatatgtacttgaaatttattcattacttcattcaaacatgcaacaaattttatgaaacatttactcctacgtcagacatggttttagaattagagatttagtcatgaacaaattaaaccgaattcctgtacttttgcagcttaaataccagtggcaaaaccagacaatcaataagtaaacgagtatatttttgtgagtatgtgtgtatataaaatatgaaaagagagatacagcagcatagcatcaaatagtgatgagttctctgaaaaaaaaaaacagcagggtttgggaatgaaggacaacgtggctgctgtcagttagggtgctcagagatggccaatgtgaaaagatttgacagaggtctggatataatgaaagaatctgaatttctggggtggggtgttccacgtgaggttctaaggcagaatcatccttgctgtgctcagggatgagtatctggagtgcaatgggcagtggaagaggattggggatcccagtggagatgtagtcaaaggctggtaggaaataccagtggagaggaaggtgggatagtagaaacgttggattttactctaagaatgatcagaactcattggattgttttgagccgaaatgtgacatgatctcatttgtatttaaaatataattttggttgcttttttgaaaaaatagactataacacagcagtattggaagcagaaatctcattggagaggctaccatagcaggctagacaaaagataagagtgccttggagtaattgttctaaacactttgggaggcccaggtgggaggaactcttgaagccaggagtttgagaccagcctgaggtacatagcaagactctctctctacaaacaaagttttaaaaaaagattagctgggcatagtagtgtgtgcctgtagtcttagctacttaggaggcggaagcaagaggatctcttgagcccaggaattggaggctgcagtgagctgcaatcctgtcattgtacttcagcctgggagacagagctagaccctgtcccctcccacaccaaaaactaaaaatcatttaaaatgttcataaattcagccacattgtcctccaatatgactttatcaaacctgtcttttgccagcagtatatgaaattctccttcccaaatcctcaaaagcagtgggtctccatcactttttttgtgctcggcatcatacttggcgtagagttggcctttgatcattatctgttgaatcgatgaatgaatttaagtgtcactattttgatgcttagcgatataaacttgttttgatttgcatggtttgaacttcaagatcttttcttacactgcttagaaacttgtttttcttcatgaaatacctgttcatgacatttatttattttgctcttagattttcttatgtatatgttggacttcttgatgttttccaggtattataactttgttatgtgttgtgtatgtggcagtatgtggtttttgtagactttatttttgtgtctttgatagtaccaagttgtagattttgatggatacattttatacatttttggttttgtgatcattttgggaaagttagcagtctttcatatccaatattttattctcactatttggttatatacagatagaaaaatgaagatttagcatgtttaagaaatttaaggacaaacaagttctgtgaatctcatggtcagccctttctccaaagggttgatttttcaggtgtgcttcatcatgtaatatgaaaaaacagaaagtagtgtgactggggagaatggaaggatagtatatgaagcatgattacaattttatttaatattaaaaactaccttatagctagatgtatggatgattttttattttccttatacgttctgtaatttccattttttcgaagtgtatgctgtgtgtgtgagagtgtgtgtctgtgtgtgtaatgagacattaaagtggccctagtccagcaggaaatgacatgtctggggcaacagggtagcaaaacttcagataaggaaatctgaaatgaacagatgcccaggcttgaacagagagtagaattaagtggtttttcattggaattatggagggagaatgaaatttctgaaaatcataatggaatgggaggaaaaaaagtaaacatagttaaaaaaaaaaacgatcatttaaagaagactaggaaatgagtaaaaagactgagggaggaaggggaattctaagtgaaacgataggggtccatatcacattgcatcctgttaaagctgtgtcaaaagtgtatgtttcttggccaatggagtactggatatggaagacatcttctagttagggcagcaatacatgacagacatcgataatcagtcagagccctccttcacttctttgctaagtcttcacagtgcaggtcttaagtaaaatgtgtcagggttgatgctcaaacataaactgtgtcccgcgtaactgtagttgcacgccctcattgtgaatataagtaagacagagaaagatcttgtcctcagtcgtccagctctgattatatctacctttaccaagtacatttcactatgattattttggtgctcattatccatttgatttctccttggatgattactttgtggagcaacagaaagagcatttgtaggatgactcaggaataaacctgttgatatagtttggttgcttgtttccgtcaaatctcatgttgaaatgtttccccaatgttggaggtgggcctaatgggaggtgtttgtatcaggggggtgggtggattccccatgaatggcttggtgccatacccatggtatgagtgagttctagctctggcagttcacaggagagctccttgtttaaaggtgtctggcacctcctcttctctctctcttgctccctctgttcccatgtgacatgccagctccccctttaccttctgccataagtggaaacttcctgaggctctcatgagaagcagacgctgacactgtgcttctcatatagcctgcagaaccgtcagtcaagcaaacctcttttcttaataaattatccagtctcaggtattcctctatagcaaggcaaattaaccagtatacctgcattgagttgcctccaggatgactggcctatgtgtccttgattgcttcatctgtaaaaaggcatgttgatactggacttactgggtagataaatccccattgttttttgatctatgcttctatgattcttatgagactgcaaccctagaataaaattttggcaaaatgatagcaaataacacagccatttataatggaaaactagagaaatttccatttaataagtcaaaatatgattttagagccagcatgaacacacatcagccatttttcacttctgtaataatattaatgtctacatttatttgctgtatagaaaatagtgctcattgcacattagttttttgagattcaggaaaaacaaatcatcagcactctttgacacttaatccatctcaatgtcattatatctttgaattaagttattaattacccttaattaaattcattttaaatggtggtgctttcattcctaagtgcttattttgtaattcctggaaaagtcataaattccactcagtttaacaaatattaaaatcatttcatgcaaggtatagttctagatattttaggtaaccactaatttcatatcccttggggtaaaaaaataaacatgcttccatctcttgtaactataacttctgttagagctttgctcttggcttatactttctggaagaagtaggggttggcacaggaatgggagaggaaatgatctcaatgattaaaagaaggatttgaccaattcctaagggcaagcaaacatcttgaagtttaaagaaatctcatacacgtctttctatagggagcattagatgatggataatgggctgtgttgccaacataacttttacattagatggtgtaattaatttttcatgattttgtttattgagactatgtatttagaatgaaattatatcagaaataacctagtgcaaggaattattcaaggccaaacttaagttctaatatgtttggtatctagcggcctccaggcatagcaggtatacagctaagaggcatggagcaatttcagtttctttaggcggcttttctctcaattatttctcttactttgtctttgagagacgcaagcaatctccagttgggcccttgggacaaggcatggtggccaatatgctaaatggcagctgatccatacactgtttctttctctctgtctctgtctctctaaatacaaaaaaaaagttgaaaattaaaaaaaaattttttttaattattctatttacctactcttgttatgtaagtgtggtatgtgtattacctattggcttcacttttaggtcatggaggacaatgatctacatcctaataggtggttttccagttttcctcagagtaggaaagattgtctaggaaaaatgaaaaataggagatgaaggtgaatgctaactcactgctctttgtggagagtgctctacacattatcattattattgttatttttcgagacagaatcttgctctgtcacccaggctggagtgcagtggcacgatctcggctcactgcaagctccgcctcccgcgttcatgccattctcctgcctcagcctcccgagtagctgggactacaggcacccgccaccacacccggctaattttttgtgtttttagtagagacagggtttcaccgtgttagccaggatggtctcgatctcatgacctcgtgatccgaccgccttggcctcccaaagtgctgggattacaggtatacaccttatttaaagccacaggagatgagaaagaagtgatggtctattcccaaaaccttaacaattatttctcctgaaggcataatgcatctttaagtgctaatattttttaaactgcgatagaagtatttcatgatgcgaaacaaatgctgtctaatggtgtggggctcataagtattttgcagaaattaagttgcacagaacatcccaggcatttcctgtagtagccacaaacaggtgattaggttgcctggggaaaggacatagcaaaggctttggttggtgacttccttgagttgcctggattttgcaaacagtggtgcactcatcaaatttttactgcagatgtgtgtatatgtgtgtttgtgtatatgtgttgataaaacgtgttgtattaattaatgaattctttatgaataatagactttatttttattttttatttttttttttgagatggagttccactctttcgcgatctcggctcactgcaacctccgcctcccgggttcaagtgattcttctgcctcagcctcccgaatagctgggattacaggtgcctgccacaacgcccagctaatttttctatttttagtagaggtggagtttcaccaggttggccaggctggtctcgaactccaggtgatccacccgcctcagcctcccaaagtgctgggattacaggcatgagccactgtgcctggcctagactttatatttaagagcagttttaggttcacagcaaaattgaaaggaaggtacagagatttcccatatacctactgcccccacacatgcaccaccttccacattatcaatatcctccaccaaagggatacatttgttattattattacccagaatccatagttgacattagggttcactctagattttgtatattctgtgggttttaacaaatatgtaacgacatgcacccaccaatacagaatagtttcattgccgtaaaaattctctgtgctctgtctattcatccctctccacccccaaacccctggcaatcactggtctttttactgtctccatgcatttgccttttctaggaagtcagagttggatttctacagtacctagagttttaaaattggcttctttcacttagcaatatgcatttaaatttccttcatatcttttcatggcttgatagaatgctgaataatattctgttgcctggatgtaccaccagatataggtatcctatatctggattccgactgaaggacatcttggttgcttccaagttttgggaactatgaataaagatttatttggttatgaatcaagctgctataaataaagaaatcaagctgtgttttatgtttcaatttcaaaaaatctaacaatttcatagaaaaatctgcatgcctttttctttggagaaatcacaaaagaacagtcagtaccgggaggtctgcaaggcaatccacagaggctgttgaagaatggcatggactttgcgtgggcctgagttctgcattcacagtggctcccatcccagtccccatcctcatacatcctgctcacacacacttgactcttcatgacacctccttatactataagcatttgagtttgcatctcctagggagatgggaactaattggttaattgttattttaagggttttgccttgccttcaacaaccctgggttcttggtgcatagtttgccctttatctcttcagttaatgttgctaagtcaagatttttatttggctggggggacggaaaggaatgagggtatgaatctatattattatagatagattgcattatatgaccccatatatgaccccagcatcttagaccctccttctgccaccttcccatgtggcagagccaagacccttctgcagctggtcctcacttctctttttccctcttgccacatgctcctacagcctggtgatccctgtcccatctcttgccaaatgttttgctctgagctaagtgagtaactaagtttcaaaggaagctaccatatttaatacagtgcatgaggaagaccaatttctgatttttgcttagccacagttttctttttcttttttttgttttaacctttaaaaaaaatgtggtaaaatatatataacatttatcatttaaccattcaaaagtatggtttaaccattcacgagaggcattagatacattcacaatactgtgcaaacatcaccactatctatacccaaaactttttcatcatcaacaaaatctctatccattaaacaataagtccctcttctttcttccttccctccccaacatccccagccttggtaacctgtattctactttctgtctctatgaattaggatgctttgagtgttctgggatctggtcctcactgtcagctaaactctccaagtaatcgtcactgcaatattatttttgttttgttttgtttttctggagttctgagagtgaggaatccattatcaatgacctatagcatgaacatttttgtgggggaatgtgtgtaaaggtatatagacatgaatatttgatgatctgacatcccacggtttaaacctagatggggcttctgtaaatatgaactcaaggctttaggagcctcccaagatctgacattccaagagtagagaagaatggagagacacccatgatggaattatctgttgcagacaagaacacaaagatagctttcttcatttagaactaactttgaggactttacatagacagaaatgttctgtctccttttttttttccagttacagggaatgttttccacttgtggtccctaaaaatgcagaaatatcatagggagtgaaagttaccttgtttctttaactgccgcaatctggcctcactcaacatgtagcaaatgccagaatgatagatgatagattatagtgatgtcgccctaggttaacagtctttctaggtaaggtacttctatatctgaattgaaaagtagggcagctattgcctcagatttgggattttaattacattgtttccacgtatgatattctttctaagaatgtctctagcacttagtctctgctttatacaatctaccagttaattatgtatttatgatgtaagtaatttggaggcacagagaaaggcagtggggccatttctccgcatggtcttggtctgggtgcatgtgccacatgattcacattatttacataaggaatggctttactgatttgaactggctgagtttgcttgcttttaaaactgcaacaagccaggtgctgtgccatgcacctatagtcccaaatgctagagaggctgaggtaggaggatggcttgagtccaggcgttttgagtctagcctgggcgacatagcttgagcccatatctaaaaccaaaaataagtgataataaataaataaattcaatttagatttggtttccaaggtacaactgtcaaacatctttttaaatgcaaatatttcatgtttcattttaacctaaggttgtgtcatccatttaaaatactttacagaaattggcctaactgcttatgtgtactgcttgatttgctttcctctttgttgttgtaagaaaaatgtcccactcactagtctggattactctgttgcaaaattaagggatctgaaacatctcaagctttaaaaatgtttgagcatagcttctcactaaaataatgagccctgtgtatctattgcaccgtaatctctaatatttaaaatgataaaggacttctagttcaaacccattattttcaattgagaaaattaaagtccactgaggtgtagtcaattgccagctagtgagtcaaggaagtgttaaggttatcgtcttatgctagatagagcctgggaaaggaggtgggtcttggaaatttgcggttcataacagggttgtctgtggggctggcagaaaggtagaatatgactctgtggatagagatcagggaaaaaataaagactgcagatttggggctgtatccatgtataggaaacatgagcctgacaaaaaatagagatgcagaatgagggaaggtgtggtcacttctgtaaaaatctttcaaacactgatttttgaacaattcattgctcttctgcagttgaaagaatcccaaaggaatgacacctgaatggaaaacctccaaagatcccttctggttggaggccctgggtctccaattgacccttcaaatatattattctgttcttttgtgcatttctctttttattgcaaagaaagaaaattaaaactatcatgaatgtatttaaaaattttattagtctgaacatgaccactttattgattactttattgattatgacattctttttttttttcagacggggtcttgctttgtcaccaggctagggtgcagtggtacaatcatagctcacactgtctctcaaattcctggactcaagcgatcctccctccatagcctcccaaagtactgggattacgagtgtgagccaccatacctggctgattatgaaactcttaaataccactcacacacatgacttaaggctatttttgatgatgtacagtagcactgtatccattcctggacaccagtctttgaagagtgtttggctctgtcccatatatacctattgatacaatgttttgagtgtttatttatgatataaatatatttatatttttataagtaatatacataattgctataatattaagtatcatgtacattatagggaggagtctcagaagtaatttaaggaagatgtatttgtttgtctccagcctgagtggtgcaactacatgagcttacagcattccttgaattacagatggctcatacctggggatacagattagcctttcctcctgtgaactgaaggcttccatttgtctaggtactgggtagagataattttagtgtctctttgaggaatattatctttagcaaacttgttttctctcttacaacctctcctttacaccatttgttaatttttttttttttttttttgagacagagtttcgctcttgtccaggctggagtccaatggtgcgatctcggcccaccacaacctccacctcctaggttcgagtgattctcctccctcagcctcccgagtagctgggattacaggcatgcgccaccatgcccggctaatgtttttttttgttttttttgttttttgcatttttaatagagatggggtttcgctgtgttggtcaggctggtctcaaactcccgacctcaggtgatccacctgccttggcctcccaaagtgctgggattacaggcctcagccactgtgcctggaccatttgttaatttaaaatgacacatttatggctgggtgtggtggctcactcctgtaatcacagcacttcgggaggctgaggcgggcggattatctgaggttgggagttcgagaccagcctggccaacatggcgaaatcccatctctactaaaaatacaaaaattagctgggtgtggtggcgtgtgcctgtagtcccagctactcaggaggctgaggcaggagaattgcttgaacctgggaggcagaggttgcagtgagccgagattgcgccactgcactccatccagggtgacagagccagactcagtctcaaaaacaaaaaagacacatttataatactagtaagggcacattcaatatttaaaaagaatctcatacagttttcatttttgcatattacttttcagtatattcattagagtcctaaaatttatactatcttgtattgtactcttttgacttcagaatgtcatcaaaaaatttgcttctgttaacaatataatcctactttcaattgctttttaataatcttgggtactttgagactgtaatttagctagtctccaaatttgggacatatatgagatttttttttttttttgccatcatagagaactctacatgaatcaggtttctgtctttatccttcatgcttctgttgcactatttccttggtgtgacatgccgtagtcaagaagtagaagcatgtattcttgtcattataatttcctatttttctgtgaacattttgaaatactgggttggtgtagctcttagctgtcactgtcaaatcacccccagtgtgagcccacacgttcaagattatttctctttttctcatttcaactctgagttagttccaggatatggttgtatctctgcaagattgtcagctccactgagtgcctccactcacatagatgagtggggtccctgcccagtgcttcaggtagcagttcttctctacacaatcaatgatgttaccactgcatgaagctccctgaaagtgtgcgtatggagtagtcctcgcacacaggctgaaagacatatctagctatgttgggcaactagtcccctcagaaaatgattgcctcaggaacaaatatttaagttgaattgttaagtgtggctgctaccatcgtcaatggaagagaaccaaagcactcgctattacaaaggggcctctagtggccaaaactctcagctctgaacgttgttcctttgtcctcctctctacatcctcctgagagaatggtacttcaagatttcatagggcaaatctccaacttccttttggaaaatacatgctttaccaggacgcatcatctgtccacgtgaggaacaatggaggagaccataatactctaaatctggaatatgtcagttgacctgaatgccatggggagattcagctgaccatataggataagcagggtgttgtggtctcttttgtgttgctataatagaatttctgagactgagtaattcataaagaacagatttatttatattgttctgggggctgagaaatccaaggtcaaggggctcacatctggtgagggccttcgtgtgagggcatcaccccatggtggaaggacagagggcaagcaaccatgcatgagagagagaagaaaagggggacagactcacacttttattaggaacccccttctttgaaaaccagcctactcccatggtcaagacattaacccattcacctcttttttttttctttttgagatggagtttcattcttgttgcccaggctggagtgcaatggtgcagtcttggctcactgcaaccttcgccttctgggttcaagcaattctcctacctcagcctcccaagtaaccaggattacaggtgcctgccatcaggcccggctaatttttttgtatttttagtagaggctgggtttcaccatgttggccaggctagtctcgaactctgacctcaggtgatctgcccgcctaagcctcccaaaatactgggcttacaggcatgagccaccgctcctgaccatcccatttacctcttaggggtcccacctcttagcactgttgcactggggattaaatattcaacaaatgaccttttaaaaggacacgttcaaaccacagcacaatggcactacaagttagtttccatttacaaatgagcactgaaaccaataagatttgggtaactgatatggaatcacaaaaaaaaatctaacctgaagcaattttacagtaagttggttatactgtcaactagtgtgacagtaatagaattggagtctcaggagaaagaatatctacaatgagttcatctctaggtattttgagcttttctttttgaacttcctctacgagagttttaaagtaagttatccatattttacagaaaacttcaaggattctagctggaaggagaagaaattatcaagtttctaaatatcagatcttactttattcactatttgaagtgatggaaatcagattgcagttcaatttttttttttaaagactgtactcctctcctctgccaaagctcatgcaaagccaggaaaacaaatattgatttttattttctctcatctctttcagtccaacctggttttcagtagtattgaaatcagatgtacttcatattgatctgggtcttgaaccagtataatccctgattaacacaattgaaataaccatcatcaaggtggttctaaagatagagaggaaacagtgtggacgcaatacatttctgctgtttgctgtggcttcctggttctgtgaattatgcattggatcttgggcaggaaaaaatacagccagatcctgccatcattttatgaaattagggtgagatatttggaagtagcacgcccatcaccaacactgtcaaatcattagtccatctgaatgtctggtaaatttaggtagaaatatttggtgttatcattgccttccaatctcgtctatctcaaatgctgtatcaatgttgactctgacaatagtaagggaaggctggacaatctggaaggatgggtaaggcttagcacaggtgaacagctgtatatataaccagaaaggcagggctatcaatttgagtcctctgtctataagagagggtgaactttacaagataaatatgccttatcctcagctgagcacagaagacccattaaagcaaaaaggtaactcaggcaataatcatcatggcttggtaaaaagcagttctgatagacttaatctttaaggcagaaggaggacaggctggtggttttatgagaaagtaatgaatccttttgacaattgtattaagactttatggacataagacctaagtcagagttttaaaaatggttctcagagacactgttttggctttgttcttagtcacatcccttcattcaggttagctatctgcctgccctgcaaagcccgcctcttttgtgaagcttttcctgaccacaccagtatctgctgatttatcatcttctctaatctctgaactaactgttcagagggatgaacacagtaaatactaatacatgccgtatacactccaccctctcccggcctctcaagttgtttgtaaactctattttatagttacagtccacccaacagtacaggtggactcagcaccatgtgtgtttaatttgttgccccactttgccagatccatacaacatcaatggtatcatatttatcattgcactgcccattgtctgtagtattctgcagtgcacatagtacaaaacattacagctgaattttaaagaatgatttaacattcaccagggaaattatgaaatacaatccatatgaaatatgtaatccttagcattaggacagcttctttctaaaccctgacttgtcctcacctctcaaaggtcatgtgtaatcctagccactctcaaatgtttttgtccactccaggtctcagcctattagcacatcctagttccctggccatgttgattggttcagaactagttacagtatccaattaaaaacaatgagatttttttcttgaggtatctgagaaaaagatgttcacatttcccggctggatccgaaacctcagagtaggtagggtctggagagcctgtcctcaacttgctcttccccaatgcctgggatgaaacagagtaaagtgaaggagagaaactgattcatgatgattacatggtgcattctacttccctgtaggatgtagagaaagacgattccctactttcctacttctcaagttatatgggtcaattgatttctttttcttttacatctttttcttttctccttcctttcttccttcttaatttcctgccttcaaagcttctttcatttctttttttatttaacttaagcctacttggactgtgatttctctcacttttcactaagagtactactcaatacccaacttgagttgatcctgtttctctttggtacaagagtacaattgtagtttattcatatgttcatagttggacaaattaatgtgtctacagcccaacggcaaactattgatataaatgcagtatctcctgtttttctaaatggtgtccagatttgtagagatacatttgtctatgttgtgagaattgaaagcctttcatgcataacttgaatgctctgtttatgtaagtaatttggcatttcttttcatgtgcaaagggttcctttgattttgaatgcacaggctgtgacactaagcagagaagatgagaatcagaccggggaagaataaatttcctttgtatatgactatacaaagttttaaaactttatctccctcagctcggtatttaatagacattgaagacaggaagtagggagctgtgactggctgtactcgacttttccccaatacagttattcaatttctatatatgctaccctgacaggcttatttcaattttagtcataaacaaaatttacgttttgacttgaagtgggtcaaaatcagtgtcagcattttgttttgtaatatgcccttcacatcgttgtacctttgccataatcagccagagtcagagaaaattatcatccctccctagtgggtgctcaacttaaaaaccagcagagaagatttttttttttgtaaagaatcaacaaagtatgaaaatgaaatgtcaaatgatgaaaattatatgattcaggtttgggatgctggatctttattttcagggacttatttcaaatccaggtacaagtctacagttagttttaggaattttagtgagcaatgggcaaataagttaatgctagtaaaagattgccatattactgcattttgttattgaaatgctaatttataagtagcaaattagcatttaaaaagacacaatttttgttaaaatagtggcctttcttacattttgtattagagctttactttttttctgctttaagcttcacaatgcagtggcagcttgtttcacttgagcgttcttattgattataactgctggtatgaggcaatctgtgcttcccttgtgttctgcctaacagaggttatttctttgcatgatatggagatggatatggaagaatctgggctgtcagggaaggaagtgagagccagagaggagaaagcagccagggggtggagtggtgagcctaattcccagctcttagacaatgagatagctaggagcaaacctctgttcattcttgcctgacagttgtcatggcaactctcaatccagtgacctcttttagttctctaataaacgagttgaatatttgttaagtttttggtttgtttgtttttagtatctaattctctttgagatgatcaagctgcaaactgattccataccttattgattcagactttgtaaaaagatattatgcaaagttgaagatgtgtagatttaaacatttcaatctttcttttaagagaattttctccacaataggaaggcatgtgggcattttatggtcttagccaacataagcattacacttatgaaattggtctagccttctaggctcctgccccagtgaggtccctcctcagttctgtgatcataggcaagtcagttccctgccccagctctttgccctcttccatggcatggtggggttgaaattgacagagtcacatttcccttctgactttaaagctttctgactctgaatacataatatataagtgggtttctctttttgacattacatactgtagtgaagtacagtcctgtaacaggcatctgcagactacagacgcacgttaccatgcagattgctattaatgtacagttctctccatttaatttgctgtggtttccaagactactatattttttattgagaatactaatagcctgtgtgaggtatgaaatgaatacatagtttcaataggactgggttagtgactgttggagaaaatatcttgaattagagtacactgttttattgtttatagctatcagaaagttctcctgtgaggacaataatataatgatctctatcctactatgtgctacactttatttaattggttgagatgaacatatgttgattaagaataaatttttaaaattttactaaatttgagaaaagcaacaaagtatgaggaaaacatatatgccaacaactgaaaataaaaagcaggtgattccattgttttttaatgaagcaccagtcatttccgttgggattagaatccattgtgctaggaaagtatttacagcatgatgctgccatatttgaataaagaagggacgagtggattgcctaaatggggttgaaaccatgtcaggagcacattacaacataaaccagaactcagctgagtatccaataatgttaatgggggcaaaacaagacttattaccatttgaactctatatctgaaatgggaatccgataacatggcagaaataacgtttggtttgggactaaaaacatcctagagtgtatctaagggcttaagtattcatgaattttgtttgtacacttacattatgtgttgtgttagaaaaggcagaaaaaggtagtgcttcatgtttggttgcaaagactcctgcctcagccttgttacacaggagcataacggtgcagtgtgaagcatttaagacaaaaacgttttagagtcagatctgagtaaaatctgagatttcacacttccagcagtgtaacctaagactagtttgttttttttttaatttctcctgaggcaaaattttatttttttctctttcttccatttcattgtaaccttttaaaaattgtgataagatatacataatatttttcagtgcaaccattcaaacatgtggcttatccattgatcggtagtcttagatacattcacaatgtcgcgtaactattatcactgtctatgtccccgattttcctatcatctccaaaaacaactttgtaaccatgaaagaataacttctccttctcctcctcctcatgccacctgcagccatggtaacctctattgtactttctgtctctatgaatttgcctgttttaggtagctcatgtaagtgtaatcatatatttgtccttcagtgtctggtgtatttcactaagcatggtttcaaggtccattcatgttctagcatttttcaagatttccttcctttttaaggctgaattggattccattgcatgcatataccacactttatctgttcatctgctaaatagttgatttggttgcctctgtcccttggctgttgtgaataatgctcccaagaccagctgtacaaacagatattcgagtctctgatttcaattttgtgtgtatatgccaaaaaattgaattgctgagtcatatggtaattctatttttagtgtttttgaggaactaccatgctgtttccacagcagctgcgccattcctgccaacaatgcataggtgttctaatttctccacgttctcaccgacacttgtgattttgtgtttttattttaaataataaccatcttaatggatgtgaaacagtaagttggatttgcactttcccagtagtcaattatgttgagtgtcccctcatgcacctattagtcatcaatatatcttacttggagaaatggtgtgaaagggtatacagttttcaaggttgaaacatgacaataattaggatgattggacaatttagtgaagaaaaaatattattactatagttaacatttttttggcacttattccgtgccaggctgttactaatgctataagtgcatgatctcaatcaacttttactatgaagttgaagactatgaaggtgcctttattatgatttctattgttcacttaaagacatggcatctcagggtcaacaagtatcttggcttatgttgcacagcttgtaagtggcagaaacctgatgcaaattagttctgcctgacttcaaagcatttggctgttaactgctatgccatgttgtctaatgcgtggcttgttgcctaatagcctgtcaatatatgttaaaaatccattatccccaccctcaactgaacccacacacacacacgcacacacacatgcacatgcacattcctcaactttcaagcaccattttcatcctagtataaaatgatacccacccaccccctacccaagattcccaatcttcagtcatctgtcatgtaatttcattcatgtgccttggagaggattccctaaatttatttccacaaagaagcatatcttaattaggtctgttgggagatcattctacatgggtctcttgtatttctgtttctatagcaggagaagcactatgaaatttgtttggattatatgttgaaggacatttgtagagcaaataaccttggagaaggagatactatgtctttcttccagtatattaaagacaaggtttccatttggggaaaaagtcagggcattttcttgcagcccagtgtaaaagatccaggttcttgaagattggaattcctcagctttgacacaaactactaaattgggcagcatctgcctggactgcttggtgctgttgctgccatggaacataaaggggtgagggaaactggtgcaaacatgaagtgcatattacttgtcttttttctttccatgtgcaatgaaggcccagaagtcttgggtcttctgccagcattcatgaaactgtggcagggtcacctgttagcttgcaagtgagataaagccttagactcattactcttcttgtcaaggtctaagatttattagtagccttccatgcacaccaggcagcatgctttacctatatcatttcattcatgcactctgagatatttactgttatcatcctcattattcagataaggacacaatgcctaaacaattaacttactaggctgtctgatacaatgtgttcctcataagtcaaatgtagatcccacagcaacttggtatatagcatctgataacttgaactaaacataccatttatctggctaatacacatgaaggtgtagactcatgtacgcaaacattttgtacccttctaccattgtgaatcttgcacctcaggtgccaatctctttaacttgggttatgagaaattgtagttaaagttggcagtaattaataattttgagcttattccagtttaattaaccatatatatgtaattactggggcattatgaaagacttctgacattgaggaaatagatatgaaagcagcatccatacgcacttgattctcacttgaattacactcattgctcatatgccaggtggggtgtctcacaacaacccacttcttgtatcaaataatgcatgtgttagaatccataaaacatgaatttctaatcatgtaggccacctcttcactggagaatcttctctctaagctttaggctttatatttcaatagaacattttaatacatatctagatgattaaatataagccttccatgacagtgtccaggtgggagaacctgtcaggggagataatttgggagtggagaaccaatatttttggcagccaccactgacataccctaacttgtcttgtcaactgtccttggtttgagacactgagtgtgtggaaattgctttaatgcctttgaaatgtccaaaacgccaaatattacttaaaatgtaaagcctcttcatagttaacaaagagacattaaccttctgctttgtaaactccatgtaaattacgacacaaatgtaaggtattattatactcacatttattgacaatgaaaccttttactaggtgcttttggttcatattgaaagagactttgagagccattaatggatattaaagaggtgtaatttaaatatgtctacataataaaagcatgaaattagaagtatattatctttttatgagatttgtatgtttgtgatggccttatattgaattgcagtcactaatcatcagagaaatgcaaattaaaaccatcatgagacactgtcttacagcatcagaatgactattattaaaaagtcaaaatataacagatgccgatgagcatgcgcaaaataggaacacttgtgcactgttgctggaaatgtaaattagcacaatctctatggtaaaaagtatgacgatttctcagagaactagaaatagatctaccttttgatctagcagttcccctgctgggtatctacccaaaggaaaagaaattgctatatcaaaaagaaacctgcatttgtatgtttatcacaataggaaaaggaaaagtacagaatcaatctaagtgtccatcaatggatggttggataaagaaaatgtgatgtgtgtatatatatctgtcacatttcatggcgagatatatatatcacatttcatggtgtatgtatatattcagccattaaaacagggtgaaatcatgtttcttgcagcaacatattaatagatgggactagaggtcattatcttaagtgaaacaactcagaaacagaaagtcaaatactgcatgttctcacatataagtggacctaaataatgtgtagaaatggacatacagtatggaataatagacactggagactcagaagggtgagagggagttgagggctgtgaaattacttaatggttacaatgcacattatttgggggatagttacactaaaagccctgacttgacccctatgcaatatattcatgtggcataactggacttgtgccccataaatttatacaattttttttaaatgaaaaacctggagctttcccttggctccttttcctggaagctttctcacatcctactgtgtgaaatttggatgcttttgggaacctgaagataaaggctatagctacaccttaaggatgcccaagctgtttctgtaaggagactgagcttgtgaggtttttaatagaaaaatgcgaactaacctagcagccctggacttcatgtttctgtacttttacatgggagaaaaataagctttctatcttgcttaagccaaaaaaaaaaaatgagagaagcattttatttgtaaagatggtgttggggagcttgactgcaatattctgttcacctaatcactaataaaataaatgcaggaaagctaaaagtccacatgagtatcactagcatcagctaaatcaagaaggctggggaggggcagaaaacaatgctatacatttcaacaattgctgatcagggaaacagagacaaggttgaggcatcaatcctattcctggcccgattgctcaagttcactaaagtctgagaattctcaccgatattcccaaatctgaagtgaagtgaaatcagtgatatcccaagctgacctgaactagctgctgggaaaggaccagtgaagtgggaaacaggaaccagaggctaattctctgtcaatgcatcaggttctccagggctaacaggaatagtgttaaaacttaactcactcttccctctctgggaatgagctaaatctcaatactaagcagagtgaatcctgcacagcaaattaaacaaattctcaaaaagggagcagagccaaggtatgccagccatgaatgaattgacagtaaactgagcacttcaacgtggggaatcttcaagaaatgttcagccttcaaaatgtagctggtaggggaaaacaaataagtctcatatgcaaataagtagaaagagagactcacagaaactgacctgcataatgtcatgaaagtgaaaatctggacagcattggcaagacgaaaaggaacagaatggaaactataatcgcaattcgagccagtaggtaggtgggcaggaacaaattgatggaacatagcatggaatctgtaagaaaatgtaacctaagacggaagaaaattttcgatactttatgctaaaaaatacatgaacatggctgggcacagtggctcatgcctgtaatcccagcactttgggaggctgaggtgggcagatcatgaggtcaagagattgagaccatctgcgccaacatggtgaaaccccatctctactaaaaatacaacaaattagctgggcatggtggcacatgcctgtagtcccagctacttcggaggctgaggcaggaggatcgcttgaacctgggaggtagaggttgcagtgagccgagattgcactcctgcactccagcctggtgacagagcgagagtctcaaaaaacgaacaaacaaaaaaaaaacaacaacaaccacaaaaaaaacatgaacatgagttaaactggagccccgtcactcaccaaaaagaacacaacaagaaaaagagatgaacaaagagagtgagaaacttgaacaaaaaatattgaagactaagataatacaatctcaaaatgactaagtaaaattgacaagcatatagaacaaatataactgaaaattgacttattgatatggaagacaggcatatataaccacagccaatgaacatacaagaaaaatataaagcaaagagagaaaagatgatagtttttcagagcttagaaagataagccaacataataatccattgcctatgagacagaaaagcctacacatgaaattgcaaaaggtattaaaatataatagaataagccctgatttatcccaagataatgcctagttagattattttctttgcacagatttaaaagaaaaaatttaaaatttacatacagtaaaattccctttttgaggtgcagttttctgagttttgacaaatgcatagagtaactaccaccacgattagatacagaacaatttccttatcccaaaatttcttttgtgttacccatttatagttaattcctctcttttttcaatctctggcaactgtgtcgctataattttgttacctgttcctataattttggctttttcagaatgtcatatgaatgaaaatgaacactcttgagtctgaattctttcacttagcataatgtatttgagaatcatcctttcatttattaatatgtcttcatatttttgctcagtgatattcaattgtatctttgtttcatcatttgtttatctattcccttattgaaagacgtttatgttattttcagtttccagatggttacacacacacacacacacacacacacactcccagatacatatatatatatctgtaatatatatatatatatatctgtaatatatatatctgtaatatatatatgtgatatgtatctgtaatatatatgttagatacagatatatgttatatatatctgtgatatatatatataggcacacccatatatataaagctcttatgcacattagcatatggcttttgggtgaacatacagtttgatttatcttaggtaaagacctaggagtggaattgctgggtcatatgatacatgcatgtttaacttcataagaaactgccatactattttgcattatcaccagcagtgagtgagagttcttgttgtgccacattcctgacagcatttggtagtatcagatgtttttgtttgttttttaaaaattgtagccattctaatacatgtgtagtagtatgttgtggttttaatttacatttgcctaatgaataatggtgttgaacatatgtttgtgattatttgccaccagtatatattctttgataaagtctctgtttgggtccacttttaatcgggtcatttgtttccttatcatttcattttgaaagtagttattgttaagtctgaaaccgagaaggatctgagaccttatcctattgtgagctaacaatgtagtctgccacatatatacacacacacacacacacacacacacacacacatcatatatatgtctcatatatagatgtctcatatatagatgcctcatgtctcatatatagatgtcatgtatgtatatgtcatatatatatataaagctcttatgcacattagcatactggcttttgggtgaacatacacagacatatagatgtcatctatatatatatgtcatatatagatgtcatatatatatgtcatttatatatatgtcatatatatagatatagatgtcatctatatatatgacatatatatagatgacatctatatgacatctgtatatgagaaatgaggctttctggagcagaaaagcaaacaacttattgctcttggcaaaaacagccagagcagcatcttagtgctgctccttgagcccccttggggtggtgtagtgagaatcacaggtctttctccacatacaatctgtgttagagggtacagtgtaggagaagacgatggatacactatctctagcttccaaggcattttctattcaaatagagcccctgctcaagaaacctgtactgtgcagaaatatgaaaatcttcaatgagaattttctcccagtaagcatatattctggatatggttcttttttgttgttgttagatatgtgatttgcaagtatttttcccaatttgtggtttgtcttatttatttatttagatagcatctttttttgtttttgtttttgaggcggagtcctgttctgtcatccaggctggagcgcagtggtgcgatctcggctcactgcaagctccacctcctgggttcacaccattctcctgcctcagcctcccgagtagctgggactgcaggtgcccgccaccatgcctggctaatttttttggtatttttagtagagatggggtttcaccgtgttagccaggatggtctcgatctcctgacctcgtgatctgcccgcattgacctcccaaagtgctgggattacaggcgtgagccaccacacctggcctaggtagcatcttgacagagcaaagattttaattttataaattatgatttcttttttctttcatggattatggttttgctgttctgtataaaaaaaactttgcctaacttactgtaggtcatgaagattttctcttttttctcaagttttataattgtacattttacacttacaactatcaaaaattttgagttaatatttttataaaacataaaatttggttaggattcacttttttgataactgattgttccaccaaaatttcttgaattgcctgtgtaggaaaaatcacttgaacatatatatgtgggtttctttctggagcctattcaattgcattgatccatttatcaacactttttccaattccacattgtcttaatatggtagcttttactatggtagcttttactaggtagtcttgaaaccaggtattgtgagtccacaaactttgctgtttgttttcaaagttgttttggctattctcattcccttgactttctgtcaaaattttagaataaacttgttggtatttacaataaactctactggtaccttgaggtattgtgtagactctattgatcaatttttaggaacattgatatcttattaatattgtctctaagctgggcactgtggctcacatctctaatatcaacactttgggagactgaagagggaggattgcttgagcccaggagtttgagatcagcatggcaagacttcctctctacaaaaatgtaaaacaaaaacaaaaacaaaaaaacaacttagctggtcccagtgccacatgcctatactcctagatgcttggaagtttgatgggggagggttgcttgagcccaggagttcaagtatgcagtgagctgtgattccatcatggtactccagttaggtgacagaacaataccctgtctctaatatatatatatatataatttaaaaaaacaagtaaaatattgtctcctgttctatgaagatggaatacctctttatttaattaggtcttctttaatttctgtcctcaatattttgtcacttccagaatttttgcacattttttatttgatacactagaattcaattttaatggaatagtaaatgttgcttatcttttatttccaatatttcattgaaaacatattgaaatatgacttttttggattctatggctttgctatattaccatattacttccaggagcttttttgtggatgcctttgaacttcctatgtagacaatggtgtcttctattaataggaacaatgttctttctatcttccaagtctttgtatatctccctcttcctttttttcagccttttattgcactggctgggatgtttattataatgttgaatacgatgatgtataatggactttcttcctttgttcttgaacttaggagaaatcattcagtctttcaactttaaatataacagtagtctaagcatttgttttcttttggtgtgagttgcatgatcaggttaaggaagttcccatctattttagtgttctgagatttaatctgtcaaatctgtcagttttttgtatatattttgatatggtcctgatttaacttagtctcttactatggtgattgattgattttaaaatattaagtcatctttgtgttaccaggataaactatacttggtaatatatttggtattaccatttatatatagtgctgtttttggttttctaatattttttgtgcatttttgtgtctgtgttcaacaggaatattggcctgtcattttcttttactaaaatgcctttgtccttttttattaggaagattttttttggcctcataaaattgagaagtgtcttagaagagaatatgtggaattgttatcatttgttctttaaattgttagaattctccagtgaaatgatcgaggtctggagttttatttgttggaaagtttttaacacacattagttctttagtagatatagaactcttcaggttatctgttcttgagtaagttttgctaatttgcctcactcaaggaattggcacatttcctctatagacacagacagatttgtattattctcttattatttttcttttaatgtccataaggtctcagtggtgttccttttgtattcttgatactgatatttgtgataactctctttgttttggtcaatctgtctagagtttcatcaactttattatttttcagttaaagcagcttttgatttaattgattttctcttttgcttttcagttttctatttcagtaatatcaacttattattgacaccattgatatgtttattatgtatttccttctgctttctttaggcctaaattgctcctcattttctagtttcttatgacagtagcttaggttatttattttagggctttcttattttctaatatgactcaatgctgtaaattttctgcaaatattaatttagctgtcccacatatcctgatagattttatttttatttatatttagatcaaaatactttatagttcattttggttgtcttacttaacccattaattatttagggatatgttagcttctaaatcattgtggaatcaccaatgatttttatgtaattgatttacagttcaactctgttatgctaagagatcatactttgtatgactttaattattttaaatttgctaagggttgtttaataagcaaggaaagggtctatcttggagaatatttcatggttacttgaaaatgtctattactgttggattattttctaaatgcatttacatcagtttggtcgatactgtggttcaagtctcccatattgttgctgattttctgtatgttgtatggattaatgagagagaagttttgaaatcttaaagaataatttgggacttttccatatctccttccagttctatcagtttttgtcttattttacagttctgtatatatgtgtgcgtatatatatatatatacgcacacatatatatgcacatataaatgtaatgtgtgtgtatatatgtgtgtatacatatatatatgtgtattcatatatatatatgtgtattcatatatatatatgtgtattcatatatatatatatatatatatatatatatatatgaatgtaatgtcttcttgggtaattgagccttttattcatcaagtaatggtcctcaatatccctaggaattttcctgttttatagtgaaatttgtctgatattgatatagccatcccatcattctttggtgtttatatagtttaactttctcctttattttacttttagcctgtccatgttattatatttaaagtgcatttcttgaagtcattgcatagtagggcctttttttaatgaaatctgacaatccattttgttatttgttgttgttagatcatttatatacagtaattattgacatggttttatttaggtttagcttttttattagttagattttttttccctccatttttgttccagtgttcccactttcctgctttttgggggcattatttgaatatttttatcatgatattttaattattggccttttgggatatatattttatattatacccacacaaataaatatacacacacagtatgtgtaggtgtttatatgatgttactctacataaatatacatttctaacttttcacagtctacttaaaagttaatacctttttttactgcaaacaaaatcgggatgccttccaactgtatagatttttaattttcccctttatcttactattgtaataaatattctatctatatacattgaaaactccaccatatattttaattttaactttcacactaatgcacattaaaatcagagaaaaagtctactatattattcgatatttaccattctgttgttctgccttcattttggaagtttgaggcttctcactaatattatttttctttcatctgaagtacttccgtcagcatttctttcagaacatatttattcttgaggaattatttcagactatcttcatctgagaatatctttattttatcttccttcttaaagaatatttttattgggcttagtattctgggctggtcttttcttcagcactttaagtatattgttttatgatcttcctgcctccatagtttctgatgaaaaattcagagtcatgattttttcattcctttatatgtaatgtgccatatttttgtggctcttttcagacatttggttatgaggtttctattctttgtatagaatctattctttgtatagaattggtagattcaaagtaattttgggttgagttctgaacatattgtgacattatggatctttcaaaaatcctctgaatgatattgcttgttttaaaagcaagcagtcaacttaggtttggactgtgagtgttgtctcaccttctgtgggtgattgatccaatgtcagttatgttttaaaacctttgttactctatatttgactgtcctaaaaatacatcactcttctgttattctggaacttaggtggtattttatatcatatttttactttcaaagcctttgacatgcttctttgggtctattacatgcgtgttctacttagcagtggctcagaaattttgttggtttatacacagaattaagcaattcttgtctctagctctctctgctccaagattcacctcaaagtctgcagctctcaagggcctcctccagttctgaggccagagagatgggttttttcctttggcttttacgtgcctgggctgccactaccattatcatcacaggagtgcattctgccaccgggaaagacaaggtgagaaaaaagaagagggaaaagaaacaaacaaacaaataaataagtagggattcccccatactctatggttcatgggggccctctttcccagcgatctactagaaagatttttctcgtgcctttttttttttttaatttttatacctgctgtatgtgttttaattagtccaccctcatgtcaaagttgggtgttaaggaaataatttaaaaagtgcactttccctcatactgtttgttcttcaatttttttgacttttgtctctcatttgcctgccaatatttacttttcagaagtaattttctttttgtatttctgttcagagattttagccataatcagtgaaagaggttggcaatagcaggcttatagcattttggccacagcagaagcccaggttaggatattaaacttataaattaaagaatgtgttagctatacagccatgagatgctggccgcttaataggagaatactgggccagctcctgtcatctctatttcaacagattgttcttaaaaaggagaaaatatctacacatatcagaggaaaagagagtgggatacaaaataatatatatttggccaagctgtcatttaggaagcagggagacaatatttgtaaaatttgtaaaaaaatcaagaactttgttgccactatccgtcttcagtaaaactgttcttagacaagataaagcaatatgaggaactctgaaatgttataggaatgtgctgtgtgaaaaaggtagtcagcatttaaaacatcaataaagaaatacagaatgaacaattgtggatattatggttatgaaataaaataaagcataaatcttaacattgtttattgaagatagtatgtgttatacgattgcaatttaaaaaatatgtgtatcaatctctccattaatatacctgtctgtatttaaatttgcatgtgcatatacacatgtaaatttatacacatgtaaattcacacatactacacacacagatgttagaattgaagctttatagtgttgattatgaaaaggaattattgcttttataatcacataaaacactttaatatcaaacacttaactttatttgagctggtggttttacatgtttcttttgaggacacatttatatttaaatctgatgcttaacctgtaaacatgaagggtttcatatggaaaaataaacaggttatggttgtagataatagaggaatatttaggaatatacaatattttctgaggttatagataatatttcactagaaaaacgtgaattcaatggaaatagaatctttgttattaaaaagtattggagctattctatggctatggaatacagattatgatgggctcatcaattttcattatagaattggcagattcaagtgcagcaaagtttgaacataatcaaaggtgcactgagttcatctgactgcctcattacctgtttgcatcctgtacaagtagaaagcccgatattgtaagctctcaattaactgaatagggtttgttcgctagcatcaggtattataaatttctctctaacttgagtttgagtagtatcagaggtagtgtggagtaagtgatgtcctccctgtatcttcccattcttctaggataggggaccctgtctggcattgcagcattaatatatgtacatggaataagttgttgaaagataaaagtagatactttgctactttgtgtagaggaggttcttgttatttgtattgtgtttgacatttatttgtttgtttgcttgttgatgccctacgtcatcctctgaatgatttgaggcatctgtaatgaatacatacactatctgtccatttttcttctctctgtttcacataatcttacaatttgagatattatcaataaattacatgtcaatatgaaaatagacataaatgataacaatcaagaacactgagataacagggataaaggaatgtcaaaaacattgacaattaggaagaaatagaaacatccagaatttccacgaatactgcagatatgacgcagtaaaatccaagacacactgctcggtatgcaaagccttatgtcatatttaatggcttttcagttgagtgatggtgactgattccatgcatccatgacctgagggatatttattacaacaaagatctgttcttctggggtctagttatttgggcatctgatttagtgagcacatctatttccaatactttccactaaccttgtattgacagttttagacctgctgagtccaaggctgacatagaccaacactgcagcctagttagcaaggcttatctaaggcaactgagtgttgaacagaggggcctgacctttggtgacaattgaaatgtaaggtcagtcagagactcagtactgaacattaagccaaatgaaccagctgtggaaagggttaggctcaagctgtgaaaccaggagttcctccaccagtgttgctgagccaagggcatagatgctagaagttagacccaggagggttcaccacaaggccacagttcatatcaactaattgtatactcttaaatacaaatcaggcttataaacccaggatccctttcagaatctcaatcacctaaggttaggctagttgttaagctcatttgctctagatttttattttgaaaatgcataattagactttttttttttttttgagatggagtctcattctgtcacctaggctggagtaaagttgcacaatcttggctcactgcaacctccgcctcctgggttcaagtgattctcctgcctcagcctcccaagtagctgggactgcaggcgcgcaccaccatgcccagctaatttttgtattttgggtagagacaggttttctccatgttggccaggctggtctcgaactcctgacctcaaatgatccgcctgcctcggcctccaaaagtactgggatttacaggtgcgagccactgcacctggcttaattagacattttttatccagggatctacaaaaatatttctgagaagatgcactctgctataaggtatcttgcaaaaagagaaatgaaaacaatctttgcccaaaatgttacacagttagatttaatatagtcccatttggtgtagcaatttatttccttctccacttaaagaacccctgtaagctaggcattgtctaaggcatgagaggagctagacatgggcacattattcaaagccatacaaaacattaatacaggtggataatctattatttgaaatattttgggaccagaagtgtttcagattttggattctttttctcagattttggaatgcttgcattacacttactggttaaccatcccaaatctgaaaatccctaatccaaaatactccaatgaacatttccttttaatctcatgtcggcattcaaaatgttttaaattttggaaacttggattttggatttttagattaggatgattcaacttgtaccagactgaatagaaaatgtagcaacatgctaaggaagtcataaataggataaataagatttagttgtgaccataaatggaagatgttgctgataaggaccatgaaatctggaagatccaacttttgcgtaaatagcacatgtcacttagaaagcatgtattatatgccaatttctgggtactctccacagactattttacttattttaaaaaaaattttacaggtggaaaaacagaaaaaaattaattttcccaatatataacaaaacttcagtgatgtagcagaactaggattcagatgcacagcttgaggaagttgcatcaggcttcttagatacttgtagaaaataaactgtatgatcattacactattgttgcacggggctagtcatttagtaggagcttaatacatttctctttttctgtaaagccatctttctgtctttgttgaatgaatgagtgtaacaatcactgtggaaaatagaggagggagtcaaaaaaagaaaaatgtatgtttaaaaaacagagtaaacagttgagtttacatagcttcctttttttctcccctaaactgtggaaatatccaggtaaggttggtaagtaagagaagctgaaaaacgaaaacatcaagggtacttattaaatgagggtgatggccagcttatccattgccacggctgacgcagccgtctgtgaggtctactttggcaatttgctctttagagatcttttctgtgcatgggcttcctgcctgaggttggatctgttcaacatggccttgccacttaaatgtgacaccaagccatctgatatgcccagatgaagaacgacaaagtaatcagataagtttataatctcaatgcacagttagaaaacatctggctattacagatgatttagactcatctatgatattaatattggtcttcatcccatgatatttccaggacacagacaggggtattttgcaagctgttactgatctatttgctaatatgtaaacaaattttcctgtgctcttctggatgattgtagcacagagaattgatttatagtgttttgtcaagacctccaatgtcctagattgaacaagtgagtgctgacttagtgtgactgtactggaagtctgtgaggagctggagataaatggaaatgtcaccaggatgcatggatgcctgtctctctgctacccttcacttcctctttccttagccatgaagctttgctaattaaattgaccttccttttttgataatctgaatataaatattgacaccatgctcagtattgtgagacaaacaaggaggatttaggctactaatgtcaatttcataaataattgattgcaaaaataatgaagatagtagtagttgtagtagtagaagtaattacagtagtagtattagcagcaagaataatcctagcgttcataatagctagcctgattgttgggtaggagatgagcactttgatgttccttacagaaggtttgcttagcaatgagtgaaagctcaggcagaagagtaccatgtggccacagcctggatatggtatatttatatttacccagagtggcctctgatccaatctccttatccccagttaattcctgctatatgagcaacataaattcactcttttaataacaaaccttgggagggctaactctctgggccattacccttcactagaatggaagctacctgtggacaggggctgggttttattcaccagggtatacctaggggacacccagtacagagcctggcacacagatgggattgatgcacatttcttgaataaaagaaccaattatactagtcgctaatgtcagaagaattatgatgtggtcaacttatttcctgatgttacctccacaacagccaagtttccaaggaatgagtagaacatgggagattccaggcacagggctcttggtcttagggagcaaggttgagctacaggaacatggtgagtgattgaagaaggccacaggaaagccaaacgggacaatcatctggacaaattaagttccagattttgcaacaatcatgaccatttatttagtcaacactttagtaggtacagaaaatactgctaagcgctctatcctattttatctttccagtgaatagatgaaagcagattattattccaattttatagttaaagattccaaggtttatagaggcttattgtgttgctctaggaaacaaagctaaagaataagattgtgtgtgtgtgtgtgtgtgtgtgtgtgtgtgtgtgtgtgtgtatatatatattttcagatcaaattgattccaatgctctgaacttaaagcaccaggttacactgagtcattagctagatatttatgtttatactgtccattgtttctgactttctcttcaattaataataatattaagtgaccatttagtgattttcaaacactgtaacatgtaatttcctgaatcttcgcatttaatcctcataacaagccttcaaattcagtactagtatccccatgcagcaggtgcagaactaaagaacacagtttcacagtttgaccaagatcgtgcagcttgtaagcaatcaacttggcacttgtgacctggctgtctgatactagaataagtgctcttcttaatcactgtgattcattgattcctgaatttaactaatttttggtgacaatatgctaggtaatggaaaagcagtggtgaaacaacaacagtcaaattcccttctccaaagacaatacacaaaacaggtcaagcatgtctgtttgatggtcataagtgctacagagacaaaattgggaaagggtaaagggaggctacaattggaataccagggccaggaataacctcgttttgccaggataagaaggttacaattgagggagccatacagatatctatggtgagtatatattgggccaagggaaaatcaaataaaaaatcctttggatgagactgggcctgatgaaggaaagaaatgggtgatcatatggagtgaacatgggtgggtggtaggagatgatgttagagagataacaggagaccagattgtataaaatgttgccagccacttcaggatttgagcttttatgttgagtgagatcagaagccattggagaatcttatgagaggaataagactatctcattattaaagtggatagtgtgttgtcgacagagcagggagaggtaacaacggaaacacagagacgagagacgaggctattccatgaaatgatggcttggaccaaagtggtaaaggtgtcagggaggaaagtagtcagatattaatatagtttttttttaataagtgagattttgttatgaattgaatatggagtaaggaagaaagagaggagtcaaagagcaactagaaggtgaggagactccagggagaacagtgtggggagatgagtaggtttatgtcagatgtctttatatctattagatgtctactagacatcccagtggaggtatcaaaagggtaatggcctacaggcatttgaaattcaagggagatgtgtggatcagagaggtaaatattgaagtcatcagaatatagttgttattgaaagccattaaatcaggatcaccaggcaagtaagtttagatagagaaaagaaaaaaaaagtgctgctttcaaagttactttgctaacaaagatgttaccaaagaggattataggaattctctgttgtgcttttgcaacttttctgttgcaaaacttttctgttgcctgtaagaaaagagagcattctgtgagtctaaagttagttgaaaatcaaaaattttgaaaacatgttcccacatgtggacatactcccttgggttggatctggcctctttagaaggaaataagatacttgcttattttggtctgaaccccagactttattcagaaagcttatacttgaattatcttcttgaacatcttatcacttcgtcagcttacactgagtttgtggtcaactgagttccaaggcatattctaataatctcttcttaaaccaggtctccctcattgtatctttcaaaaatgaatttactttttgacaaccctgatgatagatcatacattatacataataaatattcttaattgagtttgatacaaacacgaccgagtgctttgggctctgctttcagtgtcatagcatttaccagttaattagcatgccctctatgctgttatctgaggcttccaacattctgtcatcttttagatcactggagaaggtccagggaagcataggtactcacccagagtcagcattttcattgaccaagatctatccatgaactcttttttgctttcatccagctgtgaatttacctaccacaattatccagcagcccacatttattcatgatattattaaatatataatgagggtctctattaaattctttgatgaaataaaaacaccatctgactataacatttcttagtctaccagcccagtaggcctatcaaattatgaagcttgtcttgtcttgactaatttgcaatgaatttacactttacactgccttctagtgatcaatgtattttgttattatagcaccacaaatcatctatttaatagtccttttctactaatccaataatatgaggttgctcatgtgaattatgcaaatataagaatgtcttaggctgggcatggtggctcatggctgtaatcctactgctttgggaggccaaggcaggaggatcacttgagaccaggagtttgagactatcctgggcaatataacaagacccctgtcactgtaaaaaaaataaaaaacagctgggcatggtggcacatgcctggggtcccagctactcaggaggctggtgcaggagaattgcttgagcccaaagttcgaggctgcaataagctgtgatcacatcactacactccagcttgggcaacagagtgagaccctgtcttaaaaaagaaaacaaaagaaaacaaaacaccttgcctaccctttctgttttcgcttattattatttttttatgagaagaaacctggtagacctaacataggggtcttccagagaggtgcatactgtgaagttgtggggttattctttttttaggaagatgagggaacaggcctcataggaatcaaacagaaaatgttactgcctttgtttccgattttatgggcaatagctgtttttgatggtgtagttaaactccacaggaggcagtttaaatggcagaattaaatgtagtttggtgaaaatgtttatcaagtattttcttaaacagtttataatttgcacatttcttttctaaatggcgcttcttcattagtgcagactagagcttgctacagactgctaatgaattatgacacatctattattcatggatcttacaaatttaggtgacattctgaaggtcaccctatggtttataatcccaaatgatcttgttgaagaagctccataatgtcaccaactgtaaccatagtcacctgatttttgccaggtcgtgaccatgctttgtttgcaatggatatgtatttcagtgatatcacagcctcctgagagaaggcacagtgctcagacaagctgtaatggctattctgtgtggtttcatgtggccatgcctagtataggttgtgccccatggttgatgaaataagatgcctagctcatcttctcccccacactgctcctggtcttcctgcatgctggcctcagtgtattgttttctgaaacaaatcatttcttgatttgcttatatttaccaagattttgacagaattgaagacagttggaggaacttgggataatagtaatgtagggattgtaaggcattcgggaaaataaatagcaacagcaaatacttttatgctccaggcagtgggctaaatgcttttcatgtgttatctcatttaatccccacaacaaccctatggagatgggaactgttttacaggtgagaaaactaagggcagaaatgtcaaattgtccaacatcactgagttgttcagtgataaaactgtgatgccagccgttgtcctatggtcccagagcccccgctcctgatcactatgcagtgccaccacgtagcttttcgctgatggagaccatgccaaacatgaattctaactgtgtgttcagagatggtgttcagcaattttaatgtgattagatgcaaccgtgtgatactgctgatatctgactatttttacataaaaagatgtggtgatttgggttatgaaaaactgagagactgaggaaatgacaacaattgcaagcaactgagaagacctgctgaatcgatgcaacatgatacattggattggaccctggaacagataaaagacatcagtgaaaatactggtgacatctgaataaggtctatagtttagctcatagtggtgaaccaatgtaaatttcctggttttgataattgcactaggtaagatgttaattttaggggaagcaaggtgaagggtatgtgaaaatactctgcagtatatttgcaacttttctgtaaatctagaattattgcaaaatacagttctatttagaaagtcaaatcaacagataatttcatgtggtttaaccttaattatatatttacaaagatcttaaatatttgtaacaatcacttcttatttaattatagaaacatgtatgctttctttaattatcatcctgtaaccaccagccttctccctactccccagctctaggcaaccactaatctactttgtctgtctatcagtctccctgctctggacgttttacatgaatggaattctgtaatatgtggtcttttgtgactgacatctttgatttagcgtaatgttttcaaggatcattcgtctatcatcactttgttcctttttatggacaaacaatattccattgcatagatataccccattttgttcattcatctcttaggtgatgcatatttgagttgttcacaccttttggctattatgaataatgctactgtaacattagtgtgccaatttctttgtgggaaaatattttcatttcttttagatatatacttagttttaattcaattacttctaactcgaccccggaggaaagtctcttggagagaaggaataaaagaacctgaacgtgctaaaaaattcaaattattttcagagattactacctctgtgagtctcagtttattagcatcctttatagataagctgtgcctgtaagaaaagaggggtagtaaacaaacacgtatacacacacatgcttgcacaagcatgtcgtcaaaagtgtctccttcaaagaagacttctggagaaaaaaagcataaaccttctcaagctattgccattgttcgggaaattgggtaattcatctttaggaatttcttctgactgatatttggtcatactagaaaaactgaccatttctaacagcttttgcccctgcttaaacaagattgcttctggccatctctaaaaattaaatttcccctggaaactgttctttcatgatgtgtttttggaatattggctgtggttaggagggtaagctcctcaagggccaagcctgtttcctcctttctggcagagcaccttcatacaacgcaagtactcaacgtgtttgctaaactgacatcaattgaaatcattgaatcatagcacttttttggaggacgtgtctgtcttctcaatcgctcagttttcttttggaaaaaggcaggttatagagcaattcattaatcatttgctgtcccaatgttccttcctgcttttaatagcaaaaatgagtcaagacctgatcttctgaacacatcacttgctgcctacatgaggcagtggagacttagagtacccctgtggcctgctcctcctacatctcttcttttgatccctagtccttgctgaccttctgtagaggcttattcacccagcttgtgggttgaggtgatgctttcttcctatttactgagagcttccccacctctccctagatactgcataaatgcaaggaaatttccaagaggccccttcaagtataaccacagcttttcaatcatttgacattttggtcatagagcagaaccaaattatgtagtcaactatagacaccatgcctgattgaaacttgtatcaaaaatcccaagaactccaataactcttagttttactttgtactgtttttaaggaggctgatttacagcagccttttttctgaattttatttgaggaaaaatatgccctcctgccatcattccagctcctgtgacactgaggcctttggttcccttacttatatcagggtatctggggcttggttgttaatttggtgtaatgtgattaattgagacaggcatacactcaggcctaaaagataatcaaatccagaaggggaaactgaggtcctgaaagggaaaaatgggcatttacactagagtcaaaagtggatatcaggggtttggtcctgttatagaaaagttctttttctgacatttcttgatgttctatctagcctagtggactagcactaagtactgggtgactgctcagtaaatgcctctggtgggcagatggcacagaagtgcttaggggatgttctgcctcatacagagcatccaactctcctacatggatggagactcacatgatcctggtccctgcagagaaaatctgtgcatttaccacaactttgactcctaagaagctctgactttttgactaaagtcaatgggggtattttgtcagcaggcacctttaaccaggctacacttacaaattcttgtaaatcaaattttgtacaagtagatacttttataacccatcatattttaacctcaacaaagtggattctttacatccagaaatgaaacaataatgactacattattccaaaaaaaatttttttagtagttagatccaggtggatttgatggcctgattttgtcccttatactttgatatatagtatccctttatttatttaccacaagaaaaaaacccttaaaaggagggaaggagggcatctttaatagccaagcttaaaattaaaggcgactgaaatattaattcttaaacagcgctctggtttcctgagtagccaagaaagcactatttagctctttttttagactttacaggaataggaagtgctatgtatcaacatttaatttagaaactatgaatgctttcagatatgccatcttaaatgtttttacttagggtgagggttatttcagtgacatttactttgtttttgggcataattagaggatgaggatctcatataagtgcattttaaaataacgaaagcttgctcatttaagagcctatattttttatttcaaatgtttctgaagtaaatcttttaaaaatgtaattgtccaatcatttccttttgtaaacaaaagtgtttaatagacatataactcttcctaatggtccatggcaggacgcccaagtgaatctttgtgtctgggaaacttagatttgaagagaaccccagttcacccagtccatctccctcatcttcctgcccgatttatagaagaaagatttgaggagctacttccagccaaatgccctgagatttcttcggtactcttctccttccagacatccatgacctggagctttgctttcattatagaagtgctcagttgctcaggctttgccctcaacaagctgcaacccactctctttctagggttcacctcaaggagctgctgactggcccccaatgcagccccacaatgtacccctacagctcttgcacacccacttttctgtctgggattcctttccatctggtccaccttagatggccgatagccaccttgctttatctgtcataggtcatatttaaggataatttcctctggggaactttccaactcccccaggcggaaatagttcctccctacattacatccttgattttctctatgagttctcctctctcagctcttggccacatttgtaccataccttgagtgtccatctgtctttgctcactcactcattgagcttaaggattcaatccaactcatctttcctgttcccaatctgataactagcagctctctatggggataaattaattgtgggacaaagaagatactctaaatccacatcactcactcacttccaatccctctcagatgagcttcttttaatttaattcttatcaagttcttttaatttaatttttgtcaaatacttgatatcttgaatgatgaggagagaattggagagtctctgtgtgtgtgtctctgtgtgtaggaagacaagtcacatattctcaccctgagacatagtttttttctgccagccaaggagaaggagcttcctgcccatcagagaccccaccctttttacctggcagggtgtgctgtgaggcattgcccagagtgtcttgtgcaacttggggaaacgttgaaatcacaacctacagctaacaggaactactgaaccttacagagttttgtagcccatgcctaatattaatatactctgtctcctagatcacctcaaagtagtgaattttagctcttttgtctgcatgtctgcaccatgcgtatttgttgccatttgttttcattgccattgtgaagccacactgcctgtgcttacatttcgccttcattacttgatcattcaacctctcagttcttctgtttcctcactgataaaaatggtggtgtaaagactaaatggattattgtacagaaaatgttgggaagagggccggtagcaccaacacagcctgaagcatgctcgctattattactgttaagatgactgtccaacttggaaccctcacttcctgactcactgttattgtcttgggatttgctttgtctaccctctggtagctggtagaatcagactggctcaattgactgtaataagtaaggccagagtgattaggcttttagtaaggactctaaaaaaaaaaaaaaaactaaaaaatctatatgtgctctggagcacatataattttaggctgtgggttagcatccaggggccctcttttttcctttctgattcatgcctctgttaagaatagtcgaagttgccagaaaagtgatttttgtataagtaagagaggtgagatcatgttaaattaggaatcagagtcaagaaaagatgagaagctttatttagaatgagatttgggctgaaaatgactgtagatgtttttcttttttaatagtgtgagaaatacagccacaggtttgaaatggaactatttaaacgtttattttagcctagttgaaaaaagaagagagccagtctcttcctagacctgaacaatttatctttaggatgtataaagaaagtgagagactgcatgaccttgttttctctgaaattttcgctaccttgctttctgtctcttttttgctttttttgaggggggataatgtgtattgttaatgctgaaaatagtaaatgatttttttttctttgcaatagatgtggaaagttaataaaaaacaggcatcatagcctatgcaagtgtgttacagagtacagctaggtgagtgactcctgatgagccttttctccatagttctggaatcccatagactgatcatatctagatccagagttgcctatagttggtccttcaaacaggctggcctgtccgcagaacatttacagacacagtctggcctctaggcaaagttctcaactgagtgtcctgcttaaaggcaagttgtgaatttctttttaatttttattttattgtaaattgacaacttataatttcatgtatttatgaggtacaaagtgatgtttgatttatgaatgcaatgtgcaatacttaaataaatgtaacaaatatatcaatacatcaaacacttattttttgtggtgagaacatttaaaattatgaaaagatgaaatattgaattatgaaattatgaaatatacaatactgtattcttaaccatatttaccatgctgtgcaatagacctcaaaaccactgtaacaacgacaacaatgtctcctatctgaggttgagtttggttcttgaaatttgtctctctctttctttctctattgacttatctagctccctgaatatttttactgatttcacaaaaaaagttataaaatgatggaaggttttatctgccttgctcatttaatcttcacaatagccatgttagatacacatcattacccttattctaaagataaataaatggaggcatgaaaaatataaataagttacccaactttatagccagaaagtgttaaagtgagaactatagcagggtctttctgaccctggggatcttgtgttcttggctactcactacctagaaaccctaaataaattaagttctaaacttatgagatttttgccaaatgatacatagctgccaaaaaagaaccacttgaatttggacaaatatattcctgtaaatatacagggaggcttctttatcttttgacttgttatcagcttgactctcttattgataaagtggcaccatgttgagaaagagtgaaaataaagttttatgtgttacagtatttctaaaatttggaatgacgtttctgaaaacacgagcacctcttgtcctcctttctgccatccttgaatagaaatgatatggctggaaattcagggtaatggagaaagaaccctgtgctatttgtcacgacctctacttctgtgattcctccccctaaatacaaagataatgttttaagggaatatgacacagttacttcctaaaataaatgaagaattttaatgtaaatgaacgtattattttaaagaaagatggattatgatggtctgttggataaattcaggaaaagaactctttgcctaaaattacccagcctgttcaagatgcagtgatatatatggaacagctcctccacagaaagtccgagccgtttcttctcccagaaagtgacccagtaaaaatgctaaatatacacccaggtcctctctaactgtataggcaataatggaaagagatgactcagccttgtaacgacaggagacccgtggaaatggtttcttttactggagttggtctaaatttctgttttgttaaaagttttaggctatttaaaatcaatagtaatatttaacctatattttacaaaaaagaaatacatttgtttctttaaagaagttcagagatagctgactaatgagcttattaacccagggtttataatagaatgctgaaattatacacaggataagatgcatgatacctccttggctttggttttcttattttttcagggaatcacataagtcaagttagatattaaatttgcctgtatacatttatttttaaagaagatgtttcaggatatttcaattgtactgtctacaaagaatacctctggcatccaaaatggaattacctcttttgagggaccaaattgcacagaaaaccaggataagattctatctagtcatacaaatgcaagaaggtttgcttggcatttctgtggactaatattgaattccatggagtcagttgccaagagctggagattcagggtcatggatatgcttcccacagctccttctctgcatacggggagtctcattactgcctgtctgtattcctgcacatgcctccgtacccatgtttctgcctgtttcttcttcttcttccctttttttcatttgctgaaataatggatgccagtttaacttactttgttttgaagcagtacgatcaaaatctgttccagtgtacctacagcatccccactgccatgatgtaatatttgtctccatcattccagttactctacagacagttccaactggtaaattctctggtgctcgatgcctcagtgaaacttacccatctgctctgtgtaactccagtaaaccctagattccaccaccacagtttagtctggctgcaggacattcttcctcttacaccctcttgctcctggtgacatcataatcatcttctaacattggtcctcaatttcacccacctcccagatactttcaaaggagttgtatgagagagggatggggcatagactaagggacacatattggatctgccattgtacctgtaagcaattgacttgatcaatgtcttggtttcctcagttttaaacttggaagaaatagtccctcaaagagagaattcaggaacataccctacatgaactgctttctgcagagtagacagtaatgaggggtcaattcctgttttcttcccaacactcactgctttcctcattaggattgcgtgtcctctggtgctactagagaactgaacattgcatcgtttgaactttagatgacatgttagagttttgggagatattggggctttgtgctgactttttggttttattttattttgttttgtttttgagacaaggccttgctctgttgcccaggctggagtgcagtgatgaaatcatagctcactgcagcctcaaacttctgggctcaaacggtcctcccacctcagcctccagagtagctgggactacaggtacatgcctggctattttttaaattttttttatagagatggtgtctcactgtgttgcacagactagtttcaaacccctgggctccagcaatcctcctgttttggcctcccaaagtgctaggattataggcatgagccatcatggctgtcctgtgcttacttcatgtgactgttttataacaaccccccaactccaagcaggaatatatgttttgcttctttctgttcctagcagtatgaccttgagtaagtcattctcaaggtcatactgtggttcagtctcatcggtaaaatgaggctaacaatagcactgactcttgagttgctgtgaggattatatgaattcacacacgtatttagaatagtgcctcacatggagtaagtgctctatccctttatgtttaatagtaactgattttttaattataaaaccttggtcctctgtggttcttataccaaactttttgcatgggtagggcactgatcttcttcatagcagtcagaaatcccatcattttagccaagttagttttttccccttggcatttggtttgctgctggcatagtatttgcttttcctgcttttgcttatggcacagatgcatgagttagcatgactcggactggtatgttagtgtgtttttgctccgtagtttgtcttcacagatacttggtcaaacttggccattacacagtctgatgatagctctgtttcctttatgttatcattctttcagtaatgagagttgaattctttctctctcctgcctcagatcctcaggtgacattgcacaagggcagctgcagccaatgccttgtccaggcagttatattagtgttatttctagacattgtctgccctgaatacctgttagcttcctgatcttggcatactagtctgaatgagataaaaggaaacataatggtctccagtgtataggattatttgactaaacaggaacttgccatgtgttatgtgtgtcaacaaattctcatttttcatgagttctttcaactctcttattaatttcctgtgatacaagctaatatttctggctctacaacccaacttctttttactacatgatgtccgctgtcattataacacctcttaatctctctttctgtctcttcctcaatccccaaatctgctctgtgttacctgctcagatttctctataagagaatagatcctaagccaaatattactttggcagtgaaaaaaaaaaacacataagaacaccaagtgaaaagctggtgaaatggattcacgtggaactatctttaaatcttggcaccacaatttttaccttgggaaattatgaactttggtctcctatgttattttaagacagaataagtagtatacccagagtacctgttacctttaaacatggctcagtaattgaaaggcatattactagaagtatttggagataattataatacttggaatatcaacagataaaaatactagttgatttttcccctgaacttcagagacactcatttgacctccaaaatagaatgccttgttcttgatactcattttttcgtttaatacattcagtgttcctgctgcaggtgccaaatgccagccttgagtttcgtgcttttaagtagaggtatagaaaacacagagcttatggagcccactctttctcagtttatgttactttcactgtgagcacctgcttactgtttggcaaactagacataactgttcagcatctgacggataaccctgctgaggacggacactggcatcctcctccaacacctccttctgtgttcctagtgtttgccctcaaacagtctccctgcaaaggtgggagcacctgaaactaggattgaagaattcagttcatccaaaattctgttctttcttctgctggtgtcattagtttttgaggcaagtctaaatcaaccaaatatagagtctggaattctaatatagtagatctgaatgttggctgaacagtggaatcgtctggaaaaccttaaaaggtataaatgcctggtcccaccccagagctctggagcatctggatctgtatgacctggaaggcagcaattggcattagtttcttccttgctttgctccccgaggttgcttgcattgacaggggaaaccaatttcatttgacatctgatactcaggactgccccgctattctcacccccttcaatgagatgcatactaattagatgtcaagaaaagatcaaatccttcagaccctcaataccactattgcgatgtcatttcaagtattttatctatctacttcatcacagtgatctgctttagatgataggtaacttgttttatctttgagattatattggtagcttaaatttcttggttacatcaccttgaaaggtgtaggttattgggaaattctgaataggatagcgttatggagaattggctttcgaactgatgaatcctgtatttggaatctaccatctttggcaggtaacttgaactctttgggactcttcatccacatctgtaaagtgggattaatagggctgtagtaattattaacttacattggatcagatatattttgtgaaaatccacacctaacccttgcctggaatatatgaagttctcccaaaatatatactttttaccccaatgagtaaggataaaaatatttaacaagtttggctaacacaggaacagaaaaccaaacactgcatgttctcactcgtaagtgaggcggaactttctgttcctacagggaggggaacgtcacacaacggggcctgtcggggggtggagggcaagaggagggagaacattaggacaaatacctaatgcatgaggggcttaaaacctagatgatgggttgatgtgtgcagcaaaccaccatggcacaggtatacctaagtaacaaacctgcatgttctgcacatgtatcccagaacttaaagtaaaaaaaaaaaaaaaagtttaacaagtttggatgccaaatatatgttttctaaggaaaaaaataccacagtataatctgttgctttctttcagccttgtgtcattcatcacagactatttacttgacacagcaaaacatcatatcatctaataatggcccgattgtcagcttctcaatagaccaatcatcatccccatttgacaagcacattttactcagaaatgacatcaaaatgcaatatttttcttgtcaagctgaactatgccatgcctactgactcctgtatattctcaatattcattacccttttacttggtctcacccttttgctgtcaaatcgcctcattttatttatttaataatctgacaaagatgaaagaaatattaccatgggcttatgagacaattgaaatgtcctttactgtcatcattttcatttagatgagagaggcatcccccggtcatgaatttaatttaagcaatgtctgcgtgttgaatgttttgttgtgcagctgtgtcagtgtgtgtgtttatgtgtgtgtgtgtgtttccaaaagtagtttcctgaggtagactttatgtacagccctcagattaagtgatcttcaccaaactctgctctttgttatattgcaaagacattattttaaatcattcagtctataaacctgaaataaaaccttactcaattctaagtggatgtcatttaatcaacataaatcatggctgtatatatttaacattacttaaattctgttaaagttttttgaaaaatgataactagctgggacacctctttttagtaaagataaattctgaagatcttaggcaagtgttcttcaacaaataccatcaatatgctggttaaccccaaatgtatatttttagtcttgacttctattataaggcacagactcctatatcaaattagcattgctttctccaaaatattgaactcatatgaggtatgtctgtgtggctgagatcatactcattatcttccctctccaggtggttccccttccaatgtccccggctcactagaccatgcttatatattctgaatactgcccagatttgtgtaattttctttatcttcaatgttgctaattcaagtcaaggcaccgtcaggtctccctggacttcagtatgctctgtggaagaaagatgtcattctctctgtttagcaattaatctattagatagcaagattattttttcaaaaggcctgtagggagaaagacaaggtgaaagatcttaattgtggtgaccatgaaatttattttacaaacaaggacgcttaagagtgaagggagcaactactgataattattccaggactatcgccatagaaaagattagtcccaggaaactggggtgttggacagccagatcttaatacttttcactagaaagtgaatttcaccattaatgaagacatagacttgaagaattaatgtagaaatgatcgataccttagataataaattaaatatcataaggttgttattaccacttaggaaaataaatttatttttctttaacaaataaattctaaaaatattattccctataatgtataatgagtaaatttaatttttttctacaaacatgtagaacaaacttgcagtaattatagggttatatttcatagaagctgcaacatgagacatacagaacaaaagctgggtggttatgaatcaagccattctagacaatcttttggcccagtagatgtcctagtagatgtttcggtagatcagccacaagttggtgatgacaaggcacagatagtatgcagagatttaattgaaattatcacttcattctgactgctgctctttattctttatagtaattggcatataaatattccttgatgccagaaagaccaaagaattaatttctcctttggccgcttctttgaactggcattttaacctctctacacattcatgtttcttctgttttaaggaagtgatgacatttattctgcctacttcataggactctaggaatatttaatggagtagtacagatgtgagttctctgcaacctgcgtaagttctttgcaaatgattggtgttatcataagtgctagactaccagcagcaaagggaggcctattttgctggttcataagagcccaggttggagacacagttggcagtacagaagggtgccctagtcgtaagctagacaaagccttgctcacagtcttcctctgtcacaatgttataacagtttcagtgaaatttgagatatggcattctcatgactatggtgagaaagttgttttgacttgttgttcaatccttgagcaaaaataagcctttcctaaagtctgcatgctgggtccctaacacttgaaggagatccatgggccatgcggcttcagctccatgcagagggtggctgcaggtgctgcaagggcagcttaagttctggacagtcatctctgttcaatggaatttgtaaggtcaaaaagtagacttaaaaccaaagtgatggggctgggggagtggagaggaatagaccctgcctatgtgaagttagtagtggaatagttctctcctgaaggtaaacctagttttcaaattgctttgtttattggttggcttctctacctgcatgaaaagtttatgcgttttagaacgtggcaaaacaagtggagcatgacttatgtttcataatgtacagagctgatttcctgagttccaggacaatgttcagccctttagtcccttgagaagttggttctctctctctcttatccataccctcctgaaacatacactcctctaaaactcatgttatcaccagaagtgtgataccaaagcttagttaatactttgggcacagatatttggctaacttccttgtaaatatgcacagtaaacctgagtggaagtgtgccaccctttccttcttcccagttggtgccaggacaggtggcatcagcctatcctagccacctgtctccagaaaccccagtctgccccagggtggactccttagcccacactctcagcacagccactgatcttgacaatgcaaaatgcaagcatttcagagacatagtggggcatccccaccctgctaggaccttcctctctcccaccctcttcagtgcttggaggctcggctccataggaaagaaaaagaagagtcactctgtttccttcatcataggaaatttaactacctcattttcaaatcatggagtggttcagtttggaaaagcctcaaagatcacttaaggtactgaaaatttacaaatgggaaaattgaagcccataaatagaaatctcttggctaagatcacgatgttaattaatgactgagttggacttgtgttcaggtctgctgtctagtcattggccttccttctacccgtcgtgattccaatggaagataaaatgtgtgctgggacacattttatcttacctagttccggacaatcatctttattaataatgcaccatcacttaagagtatgtgcataatggcattgcatttattttctttattgatcattatgaatatttcagtgctatttcatttttctaaggactgtcataaatggctaggcatgttttagagatctcaccttaaaaatgtttttaaaaactcaaattgtgtcatgaatatggaagagatacttttcagcagttgctggaaaatgacatgtgcatcccttatattaaaactcttactttctatatgccttcccagtaagtgcctcctgtactccagagaaaaccatttagaggttagattatgataaggaaatgccttttgcatttgttgtggaatgaataaaggatttatatctttaatgctgcattgaacaaatttgcagagaacattaaatattctttaccttgacatttctgatacccatgattttgataacctttgagtcatggattgttgattacaaatgccttatatgcgtctgactcaaaatatgataagaactcaaaccagaagcatttttaaaagcttgtttaaatttctggggttttttttgttcacttcaattatttaaggaatctgaataaacagattagcttttccactttgagtttacaattagggactggaacatttcagccaataataaccatgttgatgataaaagcacactgtgtgtatgctgtcatcttaatttgcttgagatttcggtaccctaaatttttgaaggtggagtctcactctgtcatccaggctggagtgcagtggcgtgatatcggctcactgcaacctcgcctctcgggttcaagcgattctcctgtctcagcctcgcaagtagctgtgattacagatgcctgccaccatgcccagctaatttttctatttttaggagagacggggtttcaccatttcggccaggctggtctcaaactcctgacctcaggtgacccacctgccttggcctcccaaagtgctgggattacaggcataagccactgcgccagggcagtgctctaaatttttaacataatgttctcaatacacagtattcctgtaaaaaccacaatactacattgtcagagggcacagttcacattcaatttccagtgatatatctgatttttattacatgcatggttagtttaaagttagtcttagaactcctttcattctggtttccttatctcctctatagatttccttgttttaattcttatgggtacatagttggtgtatgtatgtatgaggacatgagatattttgatacaggtgtgcaatgcaaaataatcacattagggtaaatgaaatagctatcacctaaagcatttattatttctttgttttatgaacatttcaattatactctttcagttatttatatatattgttgagatggagtctcactctgttgcccaggctggagtgtagtgcagtcatggctcactgcaacctccaccttccagattcaagtaattctcctggctcagcctcccaataggcatgctccaccatgcccggctaatttttgtatttttagtagagacgggatttcatcatgttggtcaggctggtctcgaactcctgacctcaagtgatcctcccacctctgcctcccaaagtgctgggattacaggtgtgagaacccacgcctgtcctagttatttttaaatgtgtaataaattatcattgactgtaatcaccctattctgctatcaaatactagatcttattcattctatcttaactatttttttgtaaccattaaccatccccactttccctgcccattaaccatcactacccttccaagcctctagtaaccatcattctactctctatctccatgcatgcaattgtttaatttttagcttccacagatgagtgagaacatgcaaagtttgtctttctgtgctccactgtgtatatgtatcatattttctttttttttgcttctccattcatattcttttattctatcaattttttagactatatgtatgtatcactttttctttatatatatatatttttattatactttaagttctagggtacatgtatgtgcatgacgtgcaggtttgttgcatatgtatacatgtgccttgttggtgtgctgcacccattaactcgtcatttacattaggtatatttcctaatgctatccctcccctctcccccaaccccacaacaggccccagtgtgtgatgttccccttcctgtgtccaagttcatctgttgatggaaacaggttgcttctaaatcttggctattgtgaatagtgctacaataaacatgggtgtgtggatatctctttgatatactgatttcatttttttgggggggtatatacctagcagtgggattggtggattatatggtagttccatttttagtttcttgaggaacctctatattgttctctatagttgttgtactgatttgccttcctaccacaaagtacaagggttcccttttctccacattctcgccagcatttgttattgcctgtctttggataaaagccattttgactggggtgagatgatatctcattgtagttttgatttgcatttctctggtgatcagtgttgttaagcaccttttcatctgcctgtttgccattcgtgtgtctttttttgagaaatttctattcagattttttgcccattttaaaatcagattactggacttttttcctatggagttgtttgagctccttatgtattctggttattaatcccttgccacatggataatttgcaaatatttccttccattctgtaggttgtcaattcactttgttgattgttttctttgcagtgcagatgctttttaatttgatgtgatcttctttgtctatttttgctttggttgcctgtgcttgtggtgtattactcaagcaatatttactctgacaaatatcctagaaagtatccccaatgttctcttttagtattttcattgtttgaggtcttagatttaagtatttaatccattttgatttgatttctgtatatggcaagagataggggtctaatttcattgttctgcatatggatatccagttttcccagcactatttaaagagactaccctttccccaatgtatgttcttagcttgtttgttgaaaattagttcactgtaggtgtatggatttatttctgggttctctattctgttccattagtctatatgtctgtttttatgtatccatgctgtttgggttacaatagctctgtaatatactttgaggtcaagtaatgtgattcctccagtttttttctttttgcccaggttggctttgggtattctgggtcttttgtggtttccctatcaaatttaggattattttttctatttctgtgaagaatgttattggtattatgataggtgttctatcaaatctgtatattgctttgggtagtttggcattttaacaatactgattcttgcaatccatgaacatggaatatctttattttttgttctctctgtaatttcttgcatcaatgttgtatagttttcattgtagataactttaatttctttggttaagtttattcctaggtatttaattttatttgtagctattgtaaatgagattacttttttatttctttttcagattgttttctgttggcatatagaaatgctattgatgtgtgtatgttgattttatgttttccaactttgctcagtttgtttatcagtagtaatagtttttttggtgcagtcttcagacgtttccaaatgtaagattatatcatctgcaagcaaggataatttgatctcttcctttccaaattggttgccatttatttctgtctcttgtctgagtgctctacctagagtttccagtactatgttgaataacagtggagaaagtgggcattcttatcttgtaccagctcttagaggtaaggctttcagttgttccctgtttagtatgatactagctgtgggtctgtcatatatgacttttattgtgttgagatatgtttcttccatacccagttttataagtatttttattatgaagggatattaaattttaacaaatgcattttcaatatcaatggaaataatcatatggtttttgttcctcattctgttaatatgatgttatcgtgttgattgatttgcatatgttgaaccatctttgcatccctggaataaatcccaagtggtcatgatgaatgattgttttaatatgttattgaatgcagtttgctaatatcttttatatatatatgatatatatgatatatatatgatatatatatatgatatatatatatcatatatatatgatatatatgatatatatatgatatatatatatctttgtctggttttgttatcagagtaatacgggcctaatagaagtttggaagtatttcctcctcctcctctaatttttggaatagtttaagtaggattggtattagttcttcattaaatatttggtaaaattcagcggtgaagccgtctggtcttgggcctttctttgctgcgatactttttattacagctttgatctcattacttgttattcgtctattcaggttttggatttcttcatgtttcaatcttggtaggttgtatgtatctaggaatttatccttttcttgtaggtttttcaatttattgacatatatttgctcatattaatctctaattattctttgaatttcttcaatataaattatgacatatctttttcaatctctgatttatttggatcttctctttttgtagttagtttagctaaagttttgttgattttgtttatttttacaaaaaatcaacttcattttgttgattttttgtattttttatttcaattttatttatttctgctatattctttattatttcttttcttctactaattttagattttgtttgttcttgcttttctatttctttaaaatgcatcattaagttgtttatttgaaatttttctacttttttgatgtaggctcttattgctagaaacttttctcttagcactgcttttgctgtacctcatatttttttaacattgttattttgaaaaacttttattttaggtttggggatatatgtgaaggtttgttacatacataaactcatgacacaggggttgttttacagattatttcatcacccaggaattaagtcccatacccaatagttatattttctgttcgtctccctcctgccaccctgcaccctcaagtagacccccgtgcctgttgtttccttctttgtattcataagttctcttcatttagctcccacttatatgtgagaacatgtggtatttggtattctgcttctgcattagtttactgaggacagtagcctccagctccatccatattctcaccaaagacataatctccttcttttttatggctgcatagtattccatggtgtatatgtaccacgttttctttatattgtctatcatcagtgggcagttaggttgattccatgtctttgctattgtgaatagtgctgcaatgaacattcacatgcatgtgtatttatagtagaatgatgtatatttctctgggtggtatatacccggtaatgggattgctggatggaatggaagttctacttttagctctttgaggaatcgccatactgccttccacaatggttgaattaatgtacacttccatcaagagtgtatttgtgttcccttttctctgcaacctcaccagcatatgttattttttggcttttaaataatggccattctgactggtgtgggatggtatctcattgtgggtttgatttgcatttctctaatgatcactgatattgtgcttttttcatatgcttgttggctgcatgtatgtcttcttttgagaagtgtctgttcatgtcctttgcccactttttgatggggttgtttgtttttctcttgtaaatttaaattctttataggtgctggatattagacctttgtcacatgcatagtttgcaaaaatttactcccattctgtaagttgtcttgtttactctgttgaaagtttcttttcctgtgcagacgctcttaagttaattagatcccacttgtcaatttttgctttcgtagcgatttcttttggtgtctgtcatgaaatttttgctttttcctatgtctaggatggtaatgactaggctgtcttccaaggtttttatagtttggggttttatatttacacctttaatccatcttgaattgattttggtatatcgtataaggaaagggtccagcttcagtcttctgcttatggctggccagttatcccagcatcatttattgaatagagagtcttttccccattgcttgtttttgtcagctgtgttgaagatcaggtggtcataaatgtgttgccttatttctggactctctgttctgttctattggtctgtgtgcctgtttttgcatcagtattatgctattttggttattgtagccctgtagtatagtttgaaggtgggcaacatgatgcctccagctttgttctttttgcttaggattgccttggctattcgggctcttttttggttccatatgaattttaaaattcatataaaatttaaatttaaatttatgttcatctaaattttaaatttaaatttatataaaaatttcagccagacatggtggctcatgcctgtaatcccagtactttgggaggctgaggcaggcagatcacctgaggtcaggagttcaagaccagcccagccaacatggtgaaacctcatctctactaaaaaataccacaaaattagccaggcgtggtggcacatgcctgtagtcccagctactcgggaggctgaggcaggagaatcatttgaacctgggaggtggaggttgcagtgagccgagatcacacaactgcactccaaccagtgtgagtgggactccctctcaaaaaaaaaaaaaaaaattccatatgaaattaaaaattttaatatctttcctggattatagggtttccactgagaattctgctgccacatattctaaagcttcattgtatgttatttctttctttctcctgctgcttttaggatccttttttatccttgatctttggtagtttgattgttaaatgtcttgaggtaggcttctttaggctaaatctgcttggcatgctgtaactttctttaattgactattgatatctttctctagattttgaaagctctctgttattatccctttaaataaactttctaccccatttctctctctacttcctttttaaggcaaataactcttggatatgcccctttgagactattttctagatttggtagatgtgcttcattctttttgcttttgttttctctgaccttgtattttgtaatagcctgtcttcaggctcactaattctgtcatctgcttgccctattctgcttttgagagagtctgatgcattcttgaatatgtcagttgaatttttcagccttagaatttcttcttgatttttaaaaatgatttcaatcttttcgttaaatttatctgataggattctgaatttcttctttgtattttcttgaattttgtcaagcttccttaaaacagcaattttgaattctctgtctgaaatgtcacatatctctgtcactctgggattggccactggtgccttatttggtttgttttgtgaggtcatctttcctgaatggtcttgatgcttgaggatattcgtcaatgtctaggcattgaagagttgggtattttttgtagtctttgcagcctaggcttctttgtacccattcttctaggaaaggcttttcatgtattcaaatggaatagagtgctgtgatctaagtttttttgtcactgcaaccttatcagcattaggggacacaccaagcccagtaacactgacttgcagattcacagaggtagtgccttggtggtcttgggtaaaacctgagagaattctctggattaccaggcagagattcctgttttcttctcttactttccctcaaacaaatgaggtcattctcctctgtgctgagctgccttcagctgagggaggtgctaccaccattggaactgctctggttcagacttagagccagcatagcactgggtctctctcaaggcccacagcaaccattgcctggctcccacctatgttcattcaaggcccaagggctcttcattcagcatgtggaaatccagccaggcgtgtgtccttctctttattgatgtgagctcccttcagcccagggagagtccagaaatgccatgcacaagccatggcctggagtcagaaacattaggaatctacttgatgctccattttactgcagttgagctggtagcaaagccacaatacaatgttttttctactcctctctttcctcaagtaggagtctctccctgtgtccaccatagttatcaatgttctgggttacaccagaagccagtactgtatgcgggtctcacccaagtcccatggcaagtactgcctagctatctctgatgtttattcaggacccaagggctctttattcagcagaacttgggttctcaccactgggatggatgactcccctctggctagggctggtataaatgctccctccgtgggttcaggctgaattctgccatgttgctttccactctgacagacagcatcaagttctaatgcgaagtctcacaatcactgtactctttcaaacacatagattcttcataccacgtggctgctgctgggagatgagagaggggtaacgtaggcttcaagactgtctttcctaccctcttcagtacctctttcattaatatgatgtcaaaacaaggtactgtgattactcacctgattttgttttttctggaggtgctttcttgtgtggatagttgttcaatttgatgttcgtgtgggggaaacaaatgttggagggttctatttggtcatcttgttccccctccctaagctcctctgtagattttgaataccaatactcgtgagcttgttacacatcagtaagtaagaggtgtagaagaaaggaaatagcagaaaagacacttgagattctcagtcaggattgcgcttttagaaccaactctctgctctgagcctttatgttgtgagacgataaaaatgtaatatttaaattcatgctaagccgaagtgccagaatattaactaaatgcaggtgatgttatcttcctcccacaatactattattttaactgatcttaaacataaatggaaacacagctccagctagcacatttcctatatttaagccaccccatcatgaaaaaataaataggttcatgtaggaattggtaaagttccacagcttgaggcagaaattactgtttggtagcctatctgatcagttatttagacacattcgtaaacagatcagattattgatccatagaactaattgattcaagaaaacggcatttagtgaaattgaaatatcagaatttatgtcctgtctcagaatcactgggccaaaaaacataacccaggctttagtattaaaagattggagcagcaagaatttgttatgcatccactctgtgcctgaggctctgctgagcactgtagacacaggcagagtcatatactacagacagaatgttaagggtttataatccaggggatttaagttaaataccccagaatctatttcactctaaaactgaatgctaacatgcccttagtgcttttttcatgtaactcagaatgatccttgtccttaacttgggtaagtccgaagtttgacattcaggctactggtattttctcatcacttgacaatacataaagaagttaaacaaagagagtaatcagttttctgctttttgtttctcaaagttcaattttcattgccctctatagctgaagatatacagttttctaagttgtgagaaacaaatcctgtttatctatgattttccttaattcaaatacatctgtgtttagttgaaaaaaatgtgtatatgtgtgtgtgtgttttgtcttgctcttttacttatcccttcttcttgtccccagccctctgcaccagacttatttgaaaacatttttcctgggggaaaaatatgtctttagaaaagtacaaaatgcccaaaggtaggatacatttaatatgaaagaaataattattagctaacttaaatacctaatttccaagttggcttactatattggcccacatagaaagagacacctcttctgattaaagcaagcaagaccatttggtactatcttcttggcttctaatcatcctctttatagagtgatactactgacagtgggatattatacatatgaagtgtattagtcaggttctctagagggacagaactaataggatacatgtatatatgaaagggagtttattaaggagaattgactcacatgatcacaaggtaaagtcccacgataggccatctgcaagtcgaggagcaaggaattcagtggtgaatcagcgcgagtaccaaaacctcaaaagtaaggaagcctacagtgcagtcttcagtctgtggcccaagagcccctgggaaaccactggtgtaagttcaagagtcccaaagctgaaggacttggagtctaatgttcaagggcaggaagcatccagcttgggagacagatgaagaccagaagactcagcaagtctgctcttccatcttctcctgcttgctttattctagccttgtgggcagctgattagattgtgctcacccagcttgagggagggtctgtctccctctgtccactgactcaaatgttaatctcctttggcaacaccctcaaagacatatccaggaacaatactttgcatctttcaatccaatcaagttgacactcaaccttaaccatcacatgaagtatgtttgtaaataaaaatgaactctgtatcatgataatccaaggtgaaatggacatttacttttctggcaagtctgggtgttttctgcttggaaagcaatggcactaggttgcatatacagcctctaacaagcaagctcctgaaatatgatttctcattgagcaaaatggttattccacacataactgcagtttcagcagtgcctttttgtttctggttattaatttctatttaagttgtgccaaagtcattaatttactgagccaacatggaaaatgtaaggcagttaactttataaatgacaccatcatgcttcagtatatttgtgcttaatgccattataccacgtgaaagattctaatttccttatacttgatgtaactggtggtattagaatgctaagactgtggtagtgtttgttgctttaattgtactgaactgactagatacaagtagcccgttaagtcctcattgtccaatctgaaaactacattattgttaatttttttcttttggaagcatcaagctttctcaatattgtgacacttacattactgttgaagtctttaaggagagaataaatatgctaataacattctagaagcaactaactctaagcaaaagtgaatagtacagcactatcaaggtgtacacttttttccctggaaaattatctccatcaggtaatgggaaagcactgctctacagaaaagcaaaaaatgacttataagcttgattcattgttactttaaaacccttcatatctgaaggttaagctaacattaaggcagtgtacaactatcagaacaatatttcatatatttgtatttagatgaatcaccagatttgttagtctctgaatattttctatattgagccagattttagctgccatttttgtgttttaataaggttttcagttgttatccaaatatgacccagtacctgaatcaaaacagcaagctttgaggaataggtcagtatttttggataaactaacaaaaaaaatgttcatcaggctaagacatcagcagtatttgtggtagaattaatgagtattgttagtgtatattttaactgttaatagtcaatgctctattttttctatgaaaattcaacttcctagtcgactctttgcactccttcattcacttattattttacggatttccctcttgtgtcagatctctagaaattctcacttttcatctggttttacaatcattttctatttttctcagctctagaaaagtctctaaacaactccagggcagaggatccatttgtttaacagtggcttcttgatcaataattgcatgcatgaaacaaagtatcagaaatagtttgctctttacactatcaattggctgatatttaaacaaattgtctttaaagtcactgccgcaattttgtttggcaatggcattttatttaattcatttattaaatgagtttccaaaaattaagacctgaataatttatgacttcttctaatctcaacagaaataagtcaatgctggctgggtgcagtgactcacatctttagtcccaggtacttaggagggtaaggctagatgatcgcttgagcccaggagttgaagactgcagtgaactctgattactatttcactccagcctgggcaacggaaggagaccccgtctcaaaaaaataaaaataaaaagtaaaagaaaagagaaagaaataaaacaatgttaatctgtgtcttggcacgaagtttcacacttccatcaaatgggcatcattttgtgctgctaatgtctcttagggcgattttaaaacaaactaaaaatatgaaacactggatagtgttagccttacctagcttgattttctttgggtgtacatgaatgcaaataaattctacaatttcttaaattcatatatatgtatatatgcacatacatatattcatatatatgtttatgtgtgtgtatatacatgtataggtatggtgagtacatatggggaaccagttgaaggatgtttcttcttttacaagaaaggagagaaaacaatcttcccgaaaagtggtatttactagcatgaaaaaggattgagcttcatataggtagacattactgtatttctatcatagggttatgtgtgtacataatccaatctgtgtttataattcacatacctactctccattattttgatgattcaggaaagtaatttctcaaaatttttccttttgcaaatgtgctttttagataactcactggacctaaacacttggcaggcattagggtcgaccttccctgctgggttgaagaggctctttcatcccccagacctgcagactgaaagtcagccaaagtgctagagattctggcccttatgtacctgctgcctatggacttgagttttacagaaagaaagcattacttggcaaaaacctgctgatcatgtctttccccttggaacctcacagcacaaggcccaggcttactttttgattcagtgatggtgaattgatggactattatagaacttttcacttctgtgaagcagcattgtagtatcagcaccctgcatttctcttaaaataaaaaaaaaatcacagtgattctaggttttaaaaagttgtattattctgccaaaccatcataaaatgctgaatctttctagtcaattttattgcaaataactactgctaaaataaagtagaattaggtaagtaacttttttgataagcatttacattcttaagatgtgctactgttcagtatgtgtgaactcctaagttgccagtacagtgggtgctattgctatactaacgcatttcacctgtcctttacctcctcttccagaggtgcatactacgtgaagttttccaattgctgctgctttatttgcatttagtcacccagccaaaggttctcacattttatgatgctttataaaaagcttcaagagcatattttaaaagcaccctgtcagaccccatgaatacacactctgaatcaattgttacagattgaggccaacaaatattcattttttcaagctttcctggtagctcttactaattcatccaagaacatcttgttgaggaatacacaaaagattttgactgcaggattaacctatttataccaaagctttgtattcctggaatggagcagttgcaaatgctgatgactattgcattaattgatgctttgagatgtagcagtactcaacctgttctctaacatctgacactctgtgggaaaacaaaccaacaaacaaacagcaagaaggagtggttgaaatagcaaatagtcaacctggacagtatctggcctcccaagggaggcagaagtagtcctgagggatcctggggtcaaaatgtggttgtgaaacccagagaggggataagggctgggtgttcagtaggaacagtgggaacacgtgcttctggttgctgtttccttttcacttatcagtttacacgtttctaagcttagagtggggtatcgagaagcagggtctcattgggcatgtattatgctgagctcagctgacttcaggaaacatagcaaagcattataaactgtaaggaagaagacagttacgatagaaaattttatgacaacgtaatgtatctctcatggaagagctgggggatgtcctagtataagaggttctagagtcagcaataagatgtgagagtcctctctctctctctcgctctttttttttttttttttttgagacagagcaagactctatctatctccaggctggaatgcagtggtgcaatcatggctcactgcagcctcaaccttctcccacctcagcctcccaagtagctgagactatgggtgtgtgccaccacacctggctaagtttttttttttttttttttggtttctggtagagacagagtctcactatatttcccaggctgatctggaactcctgggctcaagcgatcctcctgccttggcctctgaaagtgctgggattacagacctgagccactgtgcccagccaagattttcttttttaataacacaaagaccaagaggctccccaaacagaaaagtgatgaatgatatgaacttagtgctaggttccagttcaagaatgcagactgatgctgaaatgatggcacagattgaaaggccaaggacagtttctggcatcaaagcctagggcaaggagttcaggaggcagggggcggagactaaatgcacataagttgaggataataagatgacacagggcagtcactcagaattcagtataccactaatgtgcatgttttgaatgcctcaagtcaggccaaaactattagccttattgagcatgattaggtgtgctgcttttcagacagttactgcaattacatactgtgcagttcagttcagtggttggtatagttaagcaagggggtgcctgtattgaaagattgtggactaggtttgcctgtatttcttgtttaaaagttgattctactgttacatttgttctaaacagttgcatcagtttatattagcagttgatcatctcttgcccattgaaatcaatgtgatttagaagcaagatatagaatctggagttaggtagtcctggggccttcatttaccacccttagtttattgtctgtataaatgtgataaattatgtttaccttataagtgttaaatgagtgagcatgtgtggatatgtggctgggcgcagtggcttacgcctgttatcccagcactttgagagtctcaggcaggcagattgtttcagcccaagaattcgagattggcctgggcaacatggcaaaatcctgtttctataaaaagtacaaaaattagcagggcatggtggtgcacacccgtagtcccagttactcaagagtctgaggtaggagaatcgctggagcctgggaggtcaaggctgcagtgagctgtgattgtgctactgcattccagcctgggcatcagagtgagactttgtcttaaaaaaaaaaaaaagaaaagaaaaaaaaaagaaaaaaaagaaagggcatttacttggaagcattcttggtattcagtaaatattcactgctttctccctttactatttaatattctctggcttcataaaatttgactcttatgacttctgtgctcttattcacgtgaggcttctatttaattatcttgtcaactactatgtggttgatttaaggtatgtgaaacaagcattcatctgttccacatcatgtttctccctgggaccacatctatcttatattaagtgatctttgaagcagctctaataggaattggtcccttgggacaggaaaacacctgctcctgctctctcttgtgctcgcacgtcccaggagtcctgacctgtgtattatcataggcaacaccacccaggacacctggccatcttccattcatggcctcccctttggtgaagaatgtcctcaatatttgtggcaattagcagctattcttgggtaacctttagttaaaagagagtagtctcatgggctaaagactaaaaagaagacgtgtaataaaattccagagaaacaagtcaactctgtcagtgtttatgtgaaaagagatctgggagatcagtgctcagccttccccaacagatgcacaatgttttgtagcagggaattggaaaacaaactttgacttgggattcattgtgtgactcttcattccaccaccaacaatctgtgtgacttcaagcaaaacagctactcctgaacttctgtttcctcctgtataaaaaggggatactgaagcatctaatggtttgttggaaggaatgaactgaagatcagttgtaatgctctaagacaaagctggcttatgataaatgctagtctcattctccttgttgtcttttgagaattgccctttgtttcttttatgaaaataacatttccatctttcccatcccactttttcttttaaaactgcttccctgtacacatggggcagccacccaatagctcctgaagggatatacatgtatctctttaaaggggatgcagctgtctgcattgtttgcattgcttgcacagtggtgggcactggtgtcataacccattgccatagctaagcctttctctttggtatggctggctgtgtgcatgcactagaactcggtatggtgtatttccccagagctcagtcaacaaggaattgctaaaatgaaatgccatttctgctgactgtaaatggaagaccctattttctttcataaatgtgtgaaaattcaaataattaccctactatttgatgtccaagttggtaaagatcaactagcagtaagtcccagcatttagttataacatatttgacttttgctttgagcccaagaatcttcaacatacttggctgtaaaatgggaatatcaaagctcatgtgttctcacatgatttttatggaaagcaaatgtataatgtacctgacaaggagacataggtatttgtgtgatggcctcaacatcatattaaaaccaccagtgattttcttattgatatgttaatctcttatcacatgggaacttttttctttgatggtcagtttgctttcatcttgaaagaaatcaattgttgatgtacgctgtgtgttaattgcttcgttaatactgctctggtacaataaccaactgtagctgaaataatttggcatgttcagtactgttcacgttggatagtaagtattgtgtggttaaaatgaagatatctatggcaaacttgcaacaatcccaaaacattgcttttctggttatatatccagaggcagttttttttttcccatattcattagtggtcatcgctctccacaggccattgcaatagataagtaggtagtaaccagggtaaagaattaggttgcctagaaggtcagtgaaccatacagaacttgcatatgactagctgatgcctagttgttgaggtgaacattgtgataaaatcatatttgctgggagtggctgacagaaaatattttgtgagtgagttaaacacctcacatcttgacataaggcatgtatcaagctgtttatgacagcatctgattcagaaaaagtacttttttcagtattaaccatccaatgcaaatatttaaagcctgcttttgtttctatcaaagagaatgttgggacagagattgtaaaagagaatagagcctgcatattttcagatcctactgaaatacagctaaacttagattgtttatagagaattgcacatttcaatattttagtatttgtcttactccaaatgtcgtttgggttgtctgggattttatccttggaatatattgcaagtgatctctgtgttattcgcctcagctcctgaattctgatttatcgtctctagtaagcaagccagtgagcatcacacaggagattctcagggctcagtcattcaagaagtgtggactgttgaaatttaggctttgtgtacaatctgggtaacaaaccgtaaaggcatgttttcttcctaaagctctatggaaaagtcatttgccatattacttcccccaacagcgtgcaccctgatgtggagagatgcagagtgtggtccaataataatattgaccatatgcttttctaaggcaagcagacatacagtagatactttaattttggtcgttggggtatggaaggaggtgggaagtggagaaaggagagtaacccattacctgtctggcctaagcttgttatgatctgacagatgggtagccccagggctgcttgcaaaaactatttctttttgtctccatcacagagccctggggtgtggtacagggagggttgaccaagagaggggaggcttccctgatggagtgtgaggtctggcagcaggacctgacaaaagtgagtagactgtctgggtccagccagctataaaaggaaagaacagaataacagctacagctcggtgggagttctagtacctggattttcacccaggtggatgccaggcctgattgtctatctcctgaggaatttccagactttgtcagagttcttcaggaactgaccagatccagtttgcaggttgggggtcatcactatttccattgggtcaaattggagtaagcagataccaagagtcacttacaaatcactaacatctattagatactgaccattctctcattttctcacatcaaccatgtgagataggtattattattgttcctgttttatagatgcagaatctgtgatttgtctggaaccacagctataagtggtgcagcttggatttgatctcacatttgattttccctgtgatccctgggatctggcttaggtttggatatgcctctgaacaaatggtaaacaagggaacctaaatgtccataggtgtctatttacctggttgtccttagttcagcatctttaaaatacaaaaatagatttgttgagaatactcatttccattattttaatgagaataacaactcagctaacttttaacatgaatatacactaaaaccaaaagtattatgctgatggcaatctctacttccttcttattaaagcttatgagccatggaggaccctgcccagcctgagctgcccaatgtgcctgcgttagccagcctcagtgtgtccctttgtaaagcgccccagaccttttgagtagggatgaccacttcttaattcatggtatttatcagtaatcatgcatatgcaaaattttcaacttctgcttagagcctttactaatttatttctgtgaatgctctgattccttccaaatgactctgtaagatgatggttgcaggcttcattagttcaaccttcagaatcactcaatgttacagtcccagttttctctctcttttacccaaataggctttacctatattaatgattgttgctgggctcttcgacaagatatttcaagaatgggaaaagcgttttaaaagaagtttcatgaggctttggaattcacaagctgtgagcagcactggcagatatttttccagggtgttcatttttattcatttccttatagcttttatggctaaccgttctaagacatatacagtgctgtgttgtgatcaaattttctcctctgatagaagtcaaactttgaaaacttagattcctagaattgttgaacattctaatcaaaaacttctttgagtcaatccagtttaaaatatcactgattgcgggggggtggctcacacttgcaatcccagcactttgggaggccgaggtgggaggactgcttgagcccaggagttcaagaccagcctgggcaacatagcaagaccccatttctaaaacaaacaagcaaataataataaaatatcactcatattttagttctttctaacccatggttgatactctcaaccacagagtgaggaacttactttctgcctaccatttaatctttgatctctaaaggtttggaccaaatggcttttttgccgtaagcttaaatatcttgtcttatttttttttcctacctatttgtccaggttgttttctttgcatttaggacagtggttctccatacgtgtgcatcaaaatcacctggagtataaaatacagattcctggggctggctgtggaatctctgatttggcagggtttagggagaggcctgaaactgcatttttaacatgttcctgggtcgtattgatgatactgattctcaccttgggaatcactgacctaggaaatgtcttctcttcatccaaagaaacccttacaatccccaaagatgcctttttttctcctggctgaacaaccccaatttctatgactttcctttttagacttcagcttctccaccatctcaccatccacacttcttgcttgcctgtcctgcttgcctatcactcactgaatttcagggagccaaactggcaatataaatgagtgaaccaccacaggtgggggtgagatgagtcagatagggaagacagcagagactgtctacccggaatcaactgaggaatgcagacctcacccaaacaattcacattcctgtttttttgtttttgtttttgtttttgttttttttttaagcatcaagcctacctaataaaatatgaattataaaaaataattcagttgcctagatttgaccccaatgaatgatagtttgaggtcttaaaatataattaaaatgcagcttgaacctgaaagtggcagactatcaagttattatccccagttgtttgggtttctattacatgaatccagttataaaaataacacttaatacattataaattcctaattagggagctacccagtaactgattatattgacaaagtcatgccataaataagaattaaaaagttaatataattgattagctaggatgccctcactcttgtttttgccattatttaaaatttaattgctttgcaacatttccagatgttgattttggacattttttcatgtgttttattgcctgtgagcagtttttatgtacttgtaatcggagcttttcacgtttcttggatgtagaaaaatcaattaaaatgaagcaaatatttttgaaacctaaccagacttttgtctttgttttctcataaagttcctccatagaaatgtgtggcatgggaacagagcctaatactttctgaataagatattaacaggcttgtagtggatgctgggaatttagaaagctctgttttttttttttttctaaagcctcccagtagaatgtcagactaataaatggactgcatatttccacagtgtttttatgacatgtttcacacactgtcttggtgcagatatgagaaagcccttgtccacagcccagttctgactcactcattaattttaccttgtattcagttttcttggggtggatctagactagaatagaatagaataagccgacctttaactacagtccttaaatgaggaaatctccaccctgggccagctgtgccaggaatcccgacgagatggaactccgctgtggtttataggcagggctgattttcaggggggagtgcacccatctggactccctgctgttcccatcaatctattccagccctggtacccctggaccaccctactgtccagcaactaaaggattaacaggagccacctccaggagcctccgggacccttcagaaggtgtctgatttgatggatcagaggctaggccactgccagctctctgcacatattttacatatcacccatttgcaggtgttgaagaccggtaagtgcccaggagctggcaggtgttgcaaacatgtcagtgtacctggtgggggcgctcctgcccagctgataggagacagcttctacccagcccacccctttggtggctacaccagcttggcacagtctctcattgctgaagagcatccccccgccaactccgcccaatccccacctccagtcttgactacttttcattggtttgtttgtttaaattgacatctcctgattttcaaaaccttgctgattaacaaagcaaaaagagcacacacaaaaaaaaaaaaaaaaaaaaaaaagtcaaaaacaaagcaaaaaactctcagtctaaaacagataaacaaaccaacaaacaaagcccaggggctgctagaggttgactcttgtaaactgcaagaacggacaccacaaactccagagcagagggcgcctggacattccagtgacttcatcaagcagtaaaatatccgtctttcatctgcttctgctgatgaccaatactatgcctgtcacaatttccagtcttttagagctactctttgattacacacaaccgagactttttctaagcctaggacattttctgtgtccttttaaacattgtttacatcaaaataatgatatggataggtaaaagaaaaatacaaaactacttgtgctgtaaagtagttctattttagaaaaggaaatcttgacaaaacttgagccttgttaggaaaaaagaaaaatgacaaagcagtcatgtacagaaagcctggataggattttcaatctccttgtgcaaaatctggcaaaaatgtatgctaagggtccaaagcaggaagtgctcagaaagcaaatacagaaactcagcttagcaaaggggcgaagccagagagggatataaaggaacagaggaacggctgaggatagaggtgaggaagctggactcacacagactgggtcttgctcagccttctgcagtaccagtgtcagggccaggcacacaggagtgactaggagtttgaactgaaataatgcatgactaagaattaatttgggatggtcttcaggtggaatgattggaaatgttgttttacttttaatttttcagtacatgaaagaaaagatgcctgttttctaatcattgaaatcttattatgtacagaaattttcctagcagagcacacgaggatgaaaaagaatcagatgggagatgaggatcaggactctttctgtgaatcggaacctctctgctctgctccttttctggtttcctctgtctgtccttctcttgtctccattattcatcctgtttctgccttgatgtcatcttgttggatgtcccatctcacttagtcgtctgtaatttgtaagtagcatttaaattatttgtggtctttatctaataaagctttattctctctggtcttgatgaatgaagaaggcaaactgagccttgttttttcccttattgtcttacttccccaaagcacctgaatgagttctgtgtggtctttattgacctgtgatgatcactgtcccataaaaaaagcatggtagcgtagtgcttcagcataggctctgctcagaagacttggatcccaatccttactcacttgtcgagggagtttgaacaaataagtgaatttctattgacctcactctttcacatatgtataaggggaattgtaatagtacatgtttttttaggtcattaagaggattaaatagatagaatataaaatacgttagcataagtgcctgggacagggagaatactcagctaagttggaaatcaggtgttggcaaactttttctgtaaaaggcaagaaactaaatattttaggctttgtgagtcaaagtctctgtcttaactccttaactctgccattgtaccgtgaaagcagccacagacatatgtaaatgagtgagtgtgggtctgttccagttaaaccgtatttacaaaaagggacagcaaataagatttggctcatgtctctcagtttggcgatcctattgtagaatatagttttgacatactggaaacagcttctctgtaagttaggatctgctttgttgctaactaatttaatgtgaaatttaattgacctatccatatgctacatctgacaaatagtttggcacacaatttgcttagcctttgtatctcgaggaccagagaagttaagtacgtttggccaaaagtcacccagcaaattgatgacagatctggggcagagttcagggctcgtgttctcagttctgaactatttctttttttttgaaatgtgtgttatcggggacgtagctctgtgatatcaagagactgggactgaagatctagttttgccagttgcggaacctcagatttgtaccactcactatatttggacctcagctccctcattgtcaaatagataataattcccatctcacaattttacagtgtgaaaacaagaaaatgccatatatggaaaatgccatatatttgaaatctctattgctgtggttggccagcttccttcctgccttccttcttctccttctccttcttcttcccccaccctcccctctctctctctttttctttctctttctctttttctttctttctttcttttctttctttttcttttctttctttttcttccttttctttcttctttctcctttttcttttattacttaattaacaaataataattgcatgtattaatggggtacaatgtgatactttgatacacacacgcgcacacacacattgtagaaagattaaaccaatttagttaacatttatcaccttatctacttataattattttggggatgagaacttttaaaatctactcttttagcaattttagctatgtaatatatttttatcagctatggtcaccatgctatgttacaacttattcctactgtttagctgaaactttttaccttttggtcaacattgcacctttccccattctccctatcaacctctgataaacaccactgtactctctgcttctatgagtttgacttttttagattctacatgtaagtgaaatcatacagtatttgtctctgtacttagtttattttacttaacataatgtctttcagtttcatccatgttgtcacaaatgacagaatttcttttttgtgtaaggctatatagtattccattgtgtgtgtgtgtgtgtgtgtgtgtgtgtgttttctttatcctttgatcatttggtgggcaattacattgcttttataccttggctaatgtgtataatgctgaaatgaattatgagtgcaggtatctctttgacttacttattttaattcctttgggcatatactccgtagatggattgctggatcatatgataattctgtgtaatttggggcgggggaaccactacactgttttccatagtggctacactaatttacatttctatcaacagtgtacaagggttcccttttctctgcctccttgccatcacttattatctttcgtacttttgatattagctatcctacaggtatgaggtaatatctcatgttggttttaatttgtatttccctgacaattagagatggtgaacttttttttcatatatctgttggccatttgtatgtcttcttttaataaatatctattcaggatctttattcactttttgatttggttatttcttttttttaacattcagttgtttgagttccttatatatgatggatattagccccttatcagatgtatggtttgcctatattttctcccaatcaggagggtgtctcttcactcacttcgttcttaattgttttctttgctatgcaaaaagtttttagtttggtgcaatcccatttgtctgtttttgcttttgttgcctatgcttttggggtcctatccaagaaatcgttgcccacaccaatgttgtgaagctttttctctacattttcttctagtcattttaaatttcaggccttatatttaagtctttaattcactttgagttgatttttgtgtatggtataagacaagggtacaatttcattcctctgcatatggatatccagttttgtcagcaccatttattgaagagactgtgctttccccattgtatattcttggcacctttgtcaaaaatcaattgactataaatgtgtgggtttatttcagggctctctgttctgttccattggattatatttctctttttatgccagtaccatgatgtgtgtgctattatagctttgtaatatattttgaaatcaggagtgtaatgctgttttgctttttttgctcaagattgctttggctatttggggttttttttttgtttcatataaattttagaattgttttgtctatttctgtgaaaaatgccattggaattttgatagagattgcattgaatctgtagattgctttgggtagtttggacatgtaaatgatattaattcttctaatccataagcacgggatttctttctgtttgtacatgttgcctttaatttattttatcaattttttttggttttcacttcctcaattaaatttattcataagttttctttttgaaatactattgtaaattggattgctttcttaatttcttgtttgtatagtttattgttagtgttataggaaatgtactgatttttgtatgttgattttgtaacctacaactttattgaattcttttatccattctaacaactttaggtgaacactttagggtttcttctatataagatcatcagcaaacggagacaatttcacttctcttttttatttcaatgctttttattgtctataaatttattgactgctctttaatctttcacctactttgtaagataaatttagtgaaacaggttagacagcatggaggactctgatacaaaacgattttataaaaacacacagatataaatgttttctgattaatggccattagctagtttcccaatcagagcacgttttcacctgtgctctttaaattgctttcaatgtagagttacaaaatggaaacttaagggtcagaaaaggtcaaattacattaatgacagtcctcatgatagtgttgatttaatcaggatgcctacctttgttcatttaccttttaaaaataagtataatatattgcagatcactaatactgctgttagagaaggtggttattgtattaatgggatatcagtaaccttctctctactgtgacatggattactgtaattatgaaagagacataaggaaacaccataagcactatccattgggccccaggcttcattagttctcatatggctgtgtaaaaatgctaattacaaacatatcgtaataaaaagggtatggcttaatgccaacatgtacctgctaatttgatatttatgatggtagagtgaagcacatataatcaaaagcaaagagacttcagtagagcagcattctgtattttgctgactgaagaaggctgtgagattatccagccatttatttaattaaaataatattgactggtgaccatgttattttatttagtagatgtgtaagcatattcatttaattttcaatatttatatttcatgtgattataaaaatgataaaagctcaatacataacaggtagtatggacatgtacagaaaacaaaggtagcagaatcctctaaactttagctgcttcctggtctacatttatatgcacctttctcactagaaaacatatcgattattttctgaattgtaattgttcaatttaaaaataattttaaataaggaaatgttggggaactgatatagctcagtgttgaggcagagatgttcctctgttcatatgttttggccatttttatgtgaagctgtagagaacagtgactagggtacttgtgctaacattgtcctccttattaaattggacatacatcatattttagggcaaaatttcactttctgatttctcagaaagcaaaagcgatatcaaaaagtatatcaatctacacttacatagattgattataacattttcatttattttttttttcacaaacactcattgtgttctgtctgtctttggaatgagatatacctgaatttcagtctcagctttgctccttaacaactggaaggtatgtccatgtaacatgatcccccaggcctcaacttcctcatccaaaatctatagattaaaatttgtcttctcaggtattgtgagccttttgtgagatcatctttatgaagttcctggcaagaacaggtactctgaaactgttagccagcataatgtcaatatcacctcctattattagtgccatggtattttgtgaagtgtcttattaacataaatatacatgggtaaacattttcacaaggatgtctgtaaaaaaaagaaatttctagtgaatttccagaattggaaaattgtggaatttatccttcatcagattttagctccaatggtgtctacctgccagagtgctttgaaggaagatccatggagtttaagataaagttagcttgttttacagtacctgttacttttataggtttttttacattttaatagctattaataatataggtatgattatcagcatgaagctcccatacaaataagtttatgttgaaagtgtcaatcgtcattaatatcccataagaagaaactatttaaaacttcataggagttcatacatggggttcccatggcaacaatggagcttataatttttaatttattgcttaattttctctaaactacattgtcattgcatcggcaggaatcccagtctgtagtaatgatggggattaaatggtcattatgaagttgttcaacattcttgtgatttgcttcagggaacattggctttgggtatctttgaatgtactattaagcattgttaaatccatttaaaatagactgagtttacagggaaatgaagtatattttcttattgcaatttatcatccagtaataatggtaaatattgcaagtcaaaatttaaggccaaatgtaactcaacagtgagctgactaatggctgtcttgtgcttaaagaaagtatattgcttttgcatttaaccaaatggtcattgaaaagtataaaaagatatttaatagctacaagtcatattccagaaggattcaatctgtaatataaaatgagccaaaggaatcggttgctgtcttgttaaagaagataatcattacctgagattttatttttcttataagtatctcctcctatgtcaaggtcaaactgatagcaggttagaggtttgtgtctatggacatctattttgcaaaatacagctattcataaactaatcctgaaatcatttaaaatattgcaggatcaattcaacatacctatacagtgtcaattcagggaggtcaggaaagtctgtaagggagaaatggaatattagctgggaagcatggggagaatccaaacagaagggaggcagggaataggcagaagaatgacagacatgaataccattggcagaatgtttgtggtgttattgtaagttaaaatgttaagggagaaggaggcatagaaatttgctttccaggtgggaaatttgatcaagagtctatcttttaggaaacagacaagatggaatatagatcttccagcttgtagtatgtttcaagtgttttaagaatacaacccaaacattatcaagtgatgttttaggcaaaggagaaagtaatgtgcatgatactgaatgttcctgtgagcatcaaggaacgtgattagcatcgggagccctgtgaaattgtctaggtcactcacatacctttgtgttcctttaggattattacaaaaaacactcctatcaaggtagtttagaaaacatgatctccatttaatagaaaggggatattttgtttttctagagtggtaactgaaccttgataaggaaaatatgcagaaatgagtgaaaaatggggccaagttgttgactacattgaataaaatgttagtcaacatcaaagtccttttatgaaggaaactgaattaacatgtcatttattcattgttacaaataattttcagttaaacaagtgaatattttctccaaaatggctctaaatttaattgtcatctaaatgtttgaatattttggcttttttagtctcctgtgaacatgtctgttggtctatggtgtctcacggtgtatgtgctcctgtgagcatgtctgtgtgtatgtctatgtctgtgtctccgtatgtgttgtatttgaaagtctaaaataggaggccctttaagagaagtgtttatgatgttaaaatctcaagtcttttcatggaagtgtgtctgcgcaggtaaattggatgtatatttctctctgaatgatctgactgttgggtttaataaggctatagctgatgccagttgtgttgaggagtttgcaaatttattgtcaaataaactctcctcttacactgttttgagatcattcctttgggcttatgtactttttcttcacatgtaagtaaaatgccacaaatgcttactcttgaaatcctgagagaagtggcatattatttttatgggaattgtacgattcttaaccactgtccttgattaaaataagagccttttttccttcttaaacctgatcattttcacactggaaatgaaatctttcatggggattagtttactcactcaagctttccattcagatgaaggtgtgaaaaatacatgacaagaatattatttaaatgctcaaacttctgcatgaagagcatgaaacaagaagaaaatgatagtctttagctgtagataggtttcaattttttttagtaggcttcaaattccttttaagacaaacaaaaaattaaaatagaagaccaactatgaaaataatgatttgatttaatctaaacttccatgaaggctgcaagttacagattaggtgcatcacctgaaagtaacattgctgattgcatagctttggaagctaggttcaatgatgtatatgcaagtaactaagtttcatatgcaatggttctctattgcactcaggaaattagcctggcatttaaagccattcatcatccaacctcctgaccactccaacactatcttccttcactctctcagcactccaaatatctctaactgcttgcagtttcctgaatatattactggttttcaagtctctaaaaatgttgctttccctgtctgtcatgttccttttctgttgttccatctattggactcatcctttaggatttcattccggaatcagtttccttctccaacatcttcctttgggttacctgggtggctaacgccctctgttctctcatagtaccctgggttcactccagtcatagttctttatacagaatattttaagcatgtttatttttctgcttctcttattaagtagagagaatctaagaaatagaaaccatgccttcgttagttttttagtcccatagcatcaggcttcatccctggaacatagtaggtgctcagtcaactttgttgagatagactttgtgagatgcagcagaatcaaggaaggtaaatgtcctgggttctatacagagggagttaaaaatacaaataagaagaagtcactcttctaaaggaacttgaaaaggaaaagatgcataattatcttaaatataaagctatgtgtggatgctgtcagatgttcacctggaaagagtcctggaatgaatggagcaaaaaattcaaatttcttttcactgagaggtggtggaaagccttcatgaataaagaaacatcttgagctgagcctcaaggatcctataagagttgtttattgtttgtttgtttgttttagtggatatttactgagctcacatagcctgtaagaatttaagctctgtattaccactatggttgacaagtgtgaatttaattagcccttttcaaaaaaataataaaaagcaatccattttacctacctaaacacaatagaatcatctaaatatcttattttcagtggttttctgatagaagataatgcacttattctgaagtcctgtcccctagcaacactcttcttcaccagtctgctaatggcttggcagaagaggtaaactcagttttggggcaaaagttttttaagcaggaaatcatgcaaaagtataaacagcaaacagattttaaattctgaaggttcctgggaaaagtcataggatactgaatgctttgtcatggctatacagatgaaaacatcgctaaacagagtgaatcataataatggattttgtaaggaatttctttttttttgttttgttttgttttgtttttgagacagagtcttgctctgttgcccaggctagagtgcagtggtgcaatggaatttttaaggcatagttctctgtttgcttttaacccaagcaagaagaagaaataggactgtaagagagacaagaaccctatcaatttgaataactcagggaatagcaaagtatttgactttgaatgcaggatttctctaaaacattgaatattgaagagaatattttaaggataaagaccaacattcagttagttcttgctcagtaaatgtggtagtagggaaacaagttcagcatgtgatctaagtactggcacatgaatgaacagcaaggctcataaacagccaatgagaaaatgaagctcactgttaatatgggaaatataaactagaataaaattatattggaaaaattttaaaaatatgtacaatacctggagccctgggggtatggaaaatgtgtactataatacactgttagcgaggttagacgttggtgaagtctttctgtcttgagacaaagtgaattggcatgctatttcctgagagaggaagactgggaaagaacaaggtatagggaagtattaaaaaactaagaattctatttgggaaattttaaaagattattatcaagaattcaggtggggatgtcaaataagccattgagcctggagccccaggaagtggttagtgctggaagaattggagtcaccggcatagagaaagtacatgaagttatgggactttagttatcaatcactagtttcataactagaggttggttaatggtctgctattgcagggtgcactgttctcagaatttgtgtggatatgataacacaagtcctgagttccaactttaaggagcatgaaatcttgttttaaatacagaagcaccgactatggggcaagtggtccattaaatatataaagcaatcacttcccctttttttgtacctttagtaggccagcactttgcatacattggctataatcttcacatagacatgccgaggtagatattttttccccagttttactgataagaaatctcaggctctgaaaggataagtgaattttatattaatacattcactggatagtaaatggagttgctggatttccagtcctggtctatctcattgaaagcctgttctcttttcaactgcctttcagtaacaggtgctgttgtcactgaatccttagcttcctgacccatactatctgaataatgatccctacatacttctaggaaagaaagatatcaactgcaattacccctatttgacagatggagatcctggattgctctaagtttaagcaaagcaattaagcttggccaaggtgtctgccatgggaaagcagattcactccattgcttcttagattcaaatactgcaatgtattgattattgcatgaatatattcagtggcttgatataacaaagtggcccatcactcttgatcattctcaatatcagtgtgcccaaaccctcaaatgacttgccggaagcttatatattaagggaaacttccagaatgcaatggaaaatgaaactttgtttcactagaatagattctgttcttgaagagagaataggacaatagatttggttttcatggatcaattctcattcttcaaaacttctgcaattatctgtcgaatttaaatttagctcaagtgaacactagtttccaggatgggttcaggagctcaaacttgatagctaaaggagaggtgaatggctaaaatacctccattcttgtgagcttaaatttatacataaaagtgtcaaatcactccacaaaatcactgagctttcctttttattttactttttacatttaattgctgggcagttgaacattacagggcaggctactgcatcagtactaggtgccttgctctgccatcattttgtcagttgttctgtgtgtcaaatatattattctgtttgcaaaagtcagccactgacttttaacattgtcatcatctcattctattccccactcctttttgggcagagtaaatctttctaaagacaagggcaagagaagtcactaagttattggctgccctttttcactgaacccaaagagaatacattgaagtgtcaagtgagtgagcttccaccgcttctcagcctatcatcattactggcagagaaaccagtaagtcaacccaagacagcaacggagatatgtaactatgggatgtgttgctttcaagagaattgcaactcagagctctttctagcacgtggaatcaatttaacccttttatacataagccaaagtcctcccttcatgactcagttatttgagttaataaagctctccaaatctgtctagtcctttagctaaacagtgttaactaaaccatgtgaatctcctcctctaattaacagctactttattaaaatgctattgccctgttgggaactagttggcagggtgacagagaatggagtttgtgctatggactattgattttcagttaaattcttactgtgctcttggctttctcctgcttgtggcttaaagtacccaaaccattcaggccagcaaaagaggccactttgctctccctggtttttattggcctcttttcagaaggtctaattaacctatggagtcttccaaatttaccgacagctctttcatattaatctctcttctaatataagaaatttcttttttaaccttccactcaaaaagattatttcaaaaagtgcccacaactgaaggagtgacttaatcaggttctcaaggaaaatgcctctctttactttgcaccttaagctctgccattgttattttatgttttgtgcatatatgaacttttcattcctgtctttaaaatatttatcagtcatataaaatttggataatggtgagaagcacaaagaaggagataaaaatcagcaaccagataccaactacaatattgtaaatatttaggcaatatagtccttgaggacttagattttcgattagacatcactgtcattcattacatcagtaggtgaatgagacaaattaattcaggaagctataaatgatgggaaatctctggtatgtcaatgtaggataggtgaaggctggcaagagagttctggtttagaagtggttagaaaagatctctgtgaaggctgaggaggagcaatctaggcaatgcctccaggtaggaacatggttgtcctgattgaggctaggacctttagagtcatggacaaggtaggccgtggttgatcttaggttagtaatgcaggagaagacagttcatgtatgcttttggtactatggtgaggaattcagattttattttcagtgtggtgagatgccattattgggcttcaagcaagggacctatatgatagggtctataggtttttgtttctctcttaaaattttttttttttttttgagatggagtctcgctctgttgcccaggttggagtggagtggtgcaatctagtctcactgcaacctccacctcctgggttcaagtgattctcctgcctcggcctcctgagtagctgagactacaggcatgcaccaccatgtctggctaatttttgcatttttattagagatggtgtttcaccatgttgaccaggctggtctcgaactcctaacagggatccacctgtgtaggcctcccaatgtgctgggattacaggcgtgagccacagcacctggcaaaattttttaattggtacataatatttgtacataattatggagtagatgtcatattttgttacatgcatagaatgtgtaatgatcaactcaggatatttaggatattcatcacctggagtatttatcatttctgtgtgttggaagatttcaagtcctctcttcttgctatttacaaatgtacaatatattgttgctaactctagtcaccttattctgctatgtaacattagaactccttccatctaactctacatttgtactcattaaccaacccctctttatcactctcactcgaaccactgccctttacacacacacaccctccccagcctctggtatgtatcattttactctctacctccatgaataactctggctgctgtatggagaatggattttagagagcaagagtgcaagtagcaggggggagatttggagtcaagagatggcagtacttggctgaaggttggtagtgagaggtaagaaaagaaaacagtcaagaaaaatgatatttttgcttattcatattaggaaaactaggtggggagctagtttggggaaggaaagcaaataagagttctggttttggacatgtgaactttcaacttggttatagtagtgtggaattcaagggagaagttaggattcaagatataaatcaactagtaaaggagaagttataggagttattatagtatttagccttctaatctttttcatggtttgatttaatatttttagaaaagactggcactctaatatctgtttatgccctatataacttatttattaaaacatggtatgtgcatttatatatctatgtatagatagacataaaaaatattttcatgtatatttttatataagtactatattgcattccattgtatggatgctaccatttgctaatcagttctctacaactggacatttatgctgttatattttattaatttataaatgtggtagcttttcaataaatcttgacaaatattcagttttttttctagaacaaattttcaatgagaagtagtactgggagaaattttaagaatttttatataaaaatacgatttgcattccatatcagacacctaatgatggatgctcaataattatttatttgcagactgattacagtctcattaggattacataaaggtgacattttctcttggctttggcaaaaccgaatagtgcaatttataataatgtcaattttgtaggcaaaatagcttatttattttacatatgtaaaattagggaaatgttaatatttttcatacttttcattaggcatttgttcttttgtaaacattcactcatagttgtttcctgcttttgaataggtgatcatttttttcctcattgtaaaaactctaaatacatatagaatatttaaatttttatcataaatatattacatacttgttttctttcatatttgttatttacttcttaattgcatttgtgagtttcttttttttgagagggggcgtgacagaggaatgtacaggagactttagtattttatgttgctaaagtagacttttaaaatattctaaaggaaaataagccttggaaatctaagaattattttttgtgaattgaaaaaattctcaatattccaacagactcaaataaatagctgagtaaagctaagtacatctagtcaacattttaaaatcatcttcccatttgttttcttgctattcattttttatttgtcccatctgttctttgttctcttttcctgttttctactttttttagattaattgaattttttatttttatttttaatttattattaattttttttgtgatggagtttcactcttgttgcccagactggagtgcaacagcgcgatctcagctcaccacaacctccgcctcccaggttcaagcaattctcctgcctcagcctccccagtagctgggattacaggcatgcaccaccacgcccggctaattttgtatttttagtagagatagggtttctccatgttgaggctggtctctaactcctgacctcaggtgatccgcccgccttggcctcccaaagtgctgggattacaggcatgagccaccaggtccggcctgattgaattttttaatgattccatattatgttctttgttgacctattagctataaatctctgctttgtattttagtagctgttttaggatttttcatatatctctttaactattaaaatctatatttgtgatattataatacttcatgtgtaggaaaattgccttacaataagttttttcattttgcctctcctggtctttgtggtattgttacatatatttcacttttgcccatattataaatactatattgcattgctattatttttgtttaagcaatcaataattgtttaaggatatttaaataattatgtctatatatacacacatatatatgtatatatagaaaaatatatatatttactaatttagttaccatttctggtgctcttcattcttttgtttagatcaatataatcatctggtattattttccttctgcctggaggacttgctttaacatttcaagtagtgtgggtctgctgctgacgaattcatacaaattttgtaagtctgaaacagtctttatttatcttcattactgaaaggtatttttttctcagtagtttttttttattccctccttggtattttaaagatgtgcttgactgtcttcttgctcgcattattttgataagaaatctgccatctttcttatctttgttcctatgtatgtaacgcatcttttctctctgcctgtttgtaagattttctttttatcacagatttttaaaaatttgattatgatgcacctttatatagttttattctttttaaattattttttcaaatgtggcttctatttcaactgattgaattttttcttcctcattggtcttatttttctgctttttttgcatgcctagtaattttttattcaatgtcagacattgcaaattttacttgttgggagattttattattattcataaaatttttagttttattctggcatgcaattaatttacttggtaagtgtttcattctgttagttcctgtttttatgattcgtaggctggactaaggcagtattcagtctagaacttattatttccctctccttatatatgactctctcaatagtaaacaaaatgattcttaagtctgaatatgacttagtggcagtggcatccaaaggggcagggtgatgggagtgttccaccctgtagagaattttataataattgctgtgtttactgtaaaattttataaaatatgtataagcttcatattagcacattattattacttattatattttttatatgaaggttaattcagagaactcccaatttcataattatctcctagcacacatgggctcagccacagttatttgttttcagaataagttcttttgggtttatcattgtttaaacttgtgataagcgtttgttgtacttttgtaaatatttgcttatatttaccaccttctttttaatacgtgattgtttttgtttttctcattttaaaaactccaaatacataaagattattgaatggtgtgtttatcataaatatatttcacacttgttttcttttatgtttgttatttacctattaattgtattaatgggattcttcatttttttgaagggggaaagcgtgagagggatgtacagaagagtttcttcttttatattgctaaagtagcccatcttaagattttttaaaggaaaaaaaaacccttggaaaactaagaattatgttttggaaattgaatatttgtcaatattattcctcctccttagacatgactctcttaataataaacaaaatgactattaatttaactctgaatatgactttgaatattttctctttgtgcagcctaagattgctgcatttgtcttctttctatggtagtacctgttttcatgtaggatcgttcccctaaatgtttgtcaacatttggctgtctgcttatattaaaaatgctgtgcttgaaacctattccaaggctctccgtgggtaggtggctgggaattgtccatttggcttctctcttggaagatcccagtaggaaaccctcaacatcagtatcttcaggtcatattctttggagtggtcagagtccccagagaaagaaaacattcctccactcttctacagatgtgaaatacacttgcccatcaaaatatggagagatagatgaggaaagaataatgaaagtatcaatacataatctcgagttttgagctttttcttttctcacaatgttacaacctcatccaaccagactacctagaatagtgatcatggttgacatgtgcagtcctcacctgtgaatgatatacctcagtcctggggatttctgatttaccctttgcagggaattaccctcccatctgtttccatagtggtgcaaggtaattaacccagcagtgtggagtggcctaatgtgagagaaagttctgtttgtttcttaaccagattcacagaagttctccatttttaaaattgtgctttctacatcccaattttagaggtatcatttctgccattttctcagattttggaatttttagaatctaaattgagtttccatcaatttttctgacttctagataaactgttcacctttctctggcctgctgagtcagttacattattctctgctttctagcatccaaaaggtgttttgttgattcttataccctttgttctttttaattcatgccttcctacaattcctttactagagatttattgcagtttcatgatgaagttgacctcagtactgtattcagcttaccatcttaatactcacatatctgcaaacatctttccatagcaattatgtgaagaaagcgacgagcatatgtgtaaaattttatttcagcttcatattggtatctttatgcacacctgtgtagttcttttattcttataattctaaaatgttggctagatgtacttaggtttgtatagtcatttgttttgaatgttaagaattttcaatttacaaaaatactctttttcaagagtggctatcttttaggatatcttaatcattttttttcccactttttaaagatctggtattttcttaaggaacaattatctatatttcagaattctatactcatccttctttatatattattagtttttgtaactttgtatcttttgtttttcacttcccttctgaattctaaaaatgttcttgtgttttaatttttttaattttttatttttttattatactttgagttttagggtatattacttacatctctgtaaaatgaattttgcttaatactacttccagtgtaaattttgattctacaatttgatttgtactcttccttaaaatatttctttatttcacctatctttcttataatttcactcattttgttttgcatttctacttgctctctctgtaatatttttcctgttttcttaatattcatttatttttattctctattaaagattatgtgtagtttcttctaagtttttctgatctttcagtatatcatttttattattctgttttttctgagtctattgatttttctttatattgttttccaacatttcttatttttttctttattcacctttaaatgaggtaggattttggttgatatttgttctactgttagcctacttgtgtgtaaacaaattagcttctcagataagatttcaagacttaagtttttcatgtgtgtttttttttttttgatagaccactgatctatggatatgagatattttctatctccactgttttgttctttaattctctgaactgctgtagtgcattaacaaatgttagtttctggttcacttttctatatccaaattctatactcaacacattaccagagataacttcacaacagaatagaccattctaatggagtcccatctgttcctggcctatgggtttctgaaatataccaccttttctcttgtgcagaaaaatggcatgggtgagaaaaggtctaacataatgttcagctcacagagtactactgtccaaaagacagagagagcaagcatgtggccgggtcttcagattagtagttacttgacttctgagtcaataaacagtaagtaggtaatattaaaatcatagcccaacatttttcaggcagtacctctgtattcccttgaacttaatatgcgtcttgtccaaacctgggtatttattttctccatgaaaatccatatggttcaccattcaacacctgattctgagtctcagctttttcatttattagttgtttgaccttgggcgaagtctcactaaagcttaattttctcatttttaaaatggggaataattgtgagaattgaatgagatgatgtttataaaacttgtggtatatatatatatatatatatatatatatatatatatatatatgtaaatatatataggtatataataagcatcattaaatgttaatggccatcattacaaatagagtcagctttttcaaaattgccattcgattgccagccttcagttttgatagtattgtgagtttccatatttttctttttctcacccccaattgatattccaatcagaaggtaggagaagtcatattataagttaatattgtttcaatccaaaatctctttaattttaacatttctatgttaatttgatttatgggtgttgtcagattgttttatgcagtctgagatcatttgtcttcatgtgaaggagctgaagacattaatattgattatgataatagatactctggctttattagtgtcattattttctattttctttcattttcttttcctcccatttttgtttaattctcatttagtctcctggtgcaattcaatcaatgtatttggtatgaagtatttcaaaaatagaagtcccatttttgcataaattaaaataatgtggaaagtagagacgcatcaaatcaatcattctttctcccctagttgcctggcccagtgatgtactaaaagatgaagtatactccttactagcaaggtttttcctctctttgcccagcagccctaccttacttcccaccaacatgtcctccgagccacaccttccaggatttaaagcactgcttctactttgccagcaccaaagaaaatctgtgtagagaattcttggcttagttgctctctgatagatgctgtatagaatgatataggtcataaatgggagtatgatggaaggggaagcagttatcttgcagccactaaggacctggaagcaagatgtttccttcatcagagcaggttaaattcagctgcgagtattacagttcaagttagtggcttaagcaaaatagaactacatatttcttccatgtaggagtagttcagaggtaggcaattcaagaattcatggttccaggaactcaaaaacttgctcttgtttctcatgcctggctgcttacataaccaaaattgcttcatgattcaaaataactgttgatattctggccactgcatccacgtttcatgtagcaggaaaggtaaagagggaagaacaaggatatcccttccttttaagagaatcttaagaagtgtcatgacaacactgcttcctatatcttataagatcttagtagccacacctggttgtaagaggtgataaggaatgacatttttatcactcagcaatgtgcacagctaaaataccaggattcatttacatcagaataaaggtaaatggaatttgggctaattattgcactgtgacacatctgttctgtgtttggggttgatgaaaatgccccgtatcacatcagtagcagccagtgatggaaataccaagtgtgctctgaacacctgcatggggtttctattgaggaagtgagactcaagcttactgtttcctgctgcactccattggaattaaaattggtgaacagatttctatgattcctgcgctcattgctctttttatcctattagtggacaactaataaacaaagagaatttaaagtcaagtctactgaagtggccaaccgtgttgtctaaaaggctaagaatgtgaatgttttctgacaggtacattacagcagttttcattttaaaatttatacccaagaatatgtgggttactgcttgtctttgatttatttttaatgtggacaatgaaccccaaacatgaagaagatggtttggcgaaatgtttgtaacatatgtcctttgggaagtggcttcataaactggagaatagaacaagaaatctacgcttaaatctcagcttcaagacttcaggatcccaagtggtgatcctggggctactgctaaaattcactgagattcagcttgattatatatgaaaacagagatcaccttcaatctcatcagccacagaacctgtcacactgtgtgcatctctatctccatgcctggggtcatgcctttatgcatgtaaatttaatggtctcctcattctaacttcctataagattgaaacacagaggtctgcggggcctttcccgcttgacccataatgtaatgtaaagacccatcctaacactggccttgtgatgggccctccctgtctcccttcttttacatcattcccaacaaaagcaacccatcatagttattttactaatagttgagtaaaaaatgtaaaattacctctctctctattacttttagaatgtataaaaatcaacagggagtcttcaccacaggctcctaatatgaaagtgtctgtgcaggaaaatccataagctagggtgacttttgagttaaattaaattttatggctcaaaaaatgctttgcttggttttcactaccattataaagcaaagaggataatttcagattcagtttctacaaaggattgctttgggttgatacaggctttatgttagtggcatggaagtatttgcatctgcacattgatatgtagtgaaataggctgtaaaagataagatcaatttcctgttaaaggtaaaaaggccaatgtagccagatacattaagttttttttttttccatttgtcattcaggactgtttgacagttttacattagctgtgaaaggcaccaactggtacactactgtcaagacttagaaagtaggcacacgtacacaaacacgcacacatgctgatgtaaaatataaatataaacagatagaagcctggaccatacatatgagtgccaaaaatgcagttgtcacatgcatacacacctattaaaacatagcaacacaatcttatagcaaagacatgcacacacaggtacaaggacattgaccagatgacacaatgacacagctgggattgacaattacaggtgagcaagcaagatgagggctaatgtccataggagccaagagacctagagaccctcatgtaaacacacagagatgtatgcatatgtgaacacacacacacacacacacacacacacacgcatgaaaagagagacccagagacaaggccagacaagaacacaaagatcaacacttacgtacacataactaaaaggcatgctccaaagtgtgctagagactcagaaacatagaccctcactcattcatgtagccacggcctcctgacctctggttagctatgttttcattttgtactgagacctttaaagtaatttatttgcttcaagactcttcattgactcctccttcgtccgttatatttggtctactttgaagtgtaattcatttcaaattatgtttttaggtttaattcctacaattcaggttctcatgcatcatctggactattacagtggctaccggaaattacctggagtccgtctagccctccccaagtcattcaaaattacccatgtgtggtacatcattactgggtagaagaactgcttctaaaaccaaaaaataacatagagttcattgagtccattttatatgtaaaattttgaaagactagtagtcccattattgcacacacatcaattccaaattgttcttttcaaccttgagtaatttcaaggttgaaattaaccattctcctttatcttttatcctctatccctttacctttatctcccttcatacttacctctttccagccacttaaattttccttgtttcctctttatgcacatgtttttttcgtatctccataattttgcccatcattaagccaatctttcctcattctagcctcctttaataatgctaatatgaatagttgcctggcccttcgctctgacaattacatcctatttcttctgtttgttttaagtttagaaatcccacctgtattcaagatctcattcatttatatttcaagccttaattagtaggctgtatcctcttgtagctataagtagcacagagcttagtactgtacttaatttttctttcagtccttttcaatatatcagttctccccaaatgaaatacagtcttccagaagacaggatctccactttcttcttatccttggcattttccaacccctggctcactctgttatgattttgagcactccacatcctcatactggggcatctagttcctgctgcttaaacttctgactcccaatgctgtatcctcaatcccagttagaattccaaactccagatctctacttcccattttctaatgattgaagcctatttaagccccatggattaatttcaatttacaaattcctgaaacagtacaaccctttcccattatcttactctaaattgatttttccctctcttttttaaaaaaattatggttaattgtcctaccatacatccagtcatccaagttagaatctcaggcattaatttttaccttcttgtttcctttgtttcttccccaacattagggacattaagacctacccttatatggccttgctacccatcactttctgtcatcctctctgagtgctgctctgggccatcccctcaccaacacgaggtcaggcaagaggggatgattggcttcaagctgcttctttgcttgcaattttgcctcctgtgatcagcctctctgatgctaacagaatcatcattctgaaagacaaacctgatcttgtctttcttattgaaaaaaaactttaaaggctcaagagtgccctcaaataaagtccaacctcctttagcagcagcgccttttacagcatcaccttgacctaccatctcagctcaaccatcccttcccttccatttgcatccagactatactttcctctaaatgctgaatacatcatgtctgtgatcattgtttaccaatttccctttatccaaatgcttcatttactgttctacctgggaaactatgctagattttcaagactcagttctgaaggcatccacaatttgctctgggaaaattaaacatttccataacatgttctacaaacttgtaagatagcactcattatgtggttagctgttcacatatctttctccctaattggactgtaagtccttagagaatagatcctatatcttatccatcattgtctgcccagtatgatgtcaggtaatctgtgcatagaattattggctaagttgctcatgccaaaaaatacatactttggtagacggatactatttattgcctacctaatataaattctctagttgatatatatcatttcatttgatttctacagtaactccatgatatagttgcaattgttcctgttttcctagtgagatatctgtggtctagagaaaataagaatttgaccaggttagtctgtttacttttcttttagcccatcatactctttccgtcagcagaattgaaaacgtgttcataagacattacccttgcatccaacttaggaagctctggaataaacaacaggagcaagtttcttcttgtagtagttctcaaagtctttaatacattaatatgaatcttcaagtttgtctatactgcacagtacttcccagatctattggctttagaagccattttatgagattctcatgcaggatatcctttgggaaatgtaaccttatatgaaaatgctgtctttaaataacttctggtgttcttagtctttaggagagaactcctctttcccaactctttctcaggagcatatacacatccctacccaagtgcttcttcagtgatactaatttctgactgaagtgattggcacatcacatcctggaatcctggagacctcctcctgttatatgcctctttttgctctcagcagagaggagagagatagaaatgcatgcttgctgctccctatatgtttctatccatgcccaaacacgtaggctaccctctgtcacagagcacactgaaggggagagaatgcttggattgagctgattgaactccttggttgtctcccatctccagcggtgtttggtttgggttgaatgctgtagagttgcctgtaccttctgcactctacaggagaagctgatttatttttatctctgtctgagaacaacaacatggcatcccctgatccccctggtaatttcctgggctcaatgattgctgttttccttgacctgtttcacagctggtggcactgctactgacctggatttgttttccttagctcaaatgacatagtagcccaggagatgcatggatttgacaacacaaagcctcgatttttaaaacaagacacacacacacacacacacacacaaacacacacacacactcggagggtttttggagtcagagagaacatcagttccacccctagctccaagactccaaatttcaggtctgctgcttgccaattaggacaagttactcaacatcgtagcctaccctttccttacctgcgtaataatgataatattatctacctctccgggttgtgaagaggattaaataagataccttagtgccttgaagatagcagcagtcacttaatgtttgctatgtttatattactatcatttttcaatttagacttttattgtttccctttattacatttactgtatattttctttctcatgaactacctatctaggcctgattgtgtgttttttaatctaaggagaaactaaaagaaaaatctattgatcctttctacaaagggtttgtgattatctgaggaaattaatcataaacataggaaaaggttacctatgatatatgcaatattttaattatttttaaaagaaaaggttactttgtagataaactttttagataaatccattaacactcaagtttaatgtttacataataactgagtacaaagaccaagatttgaaaagaagttttttatgtgcgtattacttagagcataatccaactaaaccagtggaactaaaaactttcaagcctagaaagtttagattcttagaataattttttttgacatggtttttctttgtcatgaaggctagagtacactggagaaatcacagctcgctgccacttctacctcttgggcctatgtgatcctcccacctcagcctcacgggtagctgggaccacaggcgtgcgccaccacatccagctaatattttctatttttttgtagagacagaatcttgttattaaacatgaacaaatgggataaactaaaagaaagattaattcagtctaccaagactaaattagaaagaaattaaaaatcggaacagacctataaccagtaaggagaagaaaaaatattgccctggttgatctcaaactcctggcctcaagcagtcctcctgcctcagcctccaaaagtgctgggattataggtgtgaggcactgtgcccagcccatgtaaattatcgaagagcccaaagagcttttgcttatgtgggtcttacccatcaatattaatgatagtaaaattaatatgagaagacttttaaaatattttattggttaatgtagaaaataaaaataaaaccaatgtattataaatattctaatgaaaaataaattattttccaaaacgccctcacacataaaaatgagaaaaagggatgatgtacatgcatatgtttcattgtgattaaaaatgcataaaataaaatttccccttttaacaaaattataagtataaaagacagtattaactataagcacgatgaggtacagcagatctctagaagtttttcattttatgtgactaatactttatatctattgaaaagcaactgctcggttagccctttgcccaggcctgggaaaaatcattctactttctgcttctatgagtttgactattttagatactttatataagtggaatcgagcagtatttgcccttctgtgactgacttatttcacttagcataatatcctgaagatccatccatgttgtagcatttgacagaattttcttctttttatggctaaatagtattttattgtatgtatttacaaaatgctgtttacctatcaaaggtcatttaggttttttatatctcttggttatagtgagtaatgctgcaatgaatatgggagtgcagatatctctctttgagatcctaatttcagttatgttagataaatacccaaaagtaggatggctcaatcatattatagttctatttttaaattcttaaagaagacttcatagtgttttccatagcatctgcaccattttaggtattccaaccagcagttcacaggggttacagtttttccacatttttgtcaacacttgttattttatgtttttctttatctttgtaaataaatataatggccataccaacaggtatgaagtgatatctcattataattttgattttcatttttctgatgatcaatgatattgaaaatcttttcatatacctattggcatttgtatgttttctttgaagaaatgtttattcaggccctttgctcatttcaaatcagataattggagctttttttgctactgaactataggagtttttttaaaaattatattttaagtgttaaccctttatcagatatatggttggaaatattttctcctattgtgtaggttaccttttcactctgttaattgtttcttttgctgtgcagaagctttttagtttgatttagtctcacttatctattttttcttttgttgtctattctttcgctgtcatatcaaaaaatgcatttccaagaataatgtcatgaagcttttcccttgtggtttattttaggagttttacagtttcaggtcttacatgtaagtctttaccacattttgagttgctttttatatatgctgcaatatatggattccatttcattgttttgcatatggatttccagttttctgaacatcatttgtttaagaggctatcttttctccattatgttcttggcatccttgtcaatgattatttgacgataaatgcattggtttatttctgggctgtgttctctgttcccttgactatatgtttgtcttatgccagtaccatatttttttattactgtagctttgtaatatgttttgaaattacagagtatgaggactctgacattcctcttctttttcaagagtgttttaactatttggggtcctttgtggttgcatattaatcttttcttttatttctgtaaagattgccttggggttttggaaaggactgcattgaatctgtagattgctttgataccatagacattttaataatatagtattaagtcttccagtcaagaaaagtagaatgtatttccatttatttgtgtttttcaaaatttctttcagtaacattttgtagttttcagcatataagtctttcttctccttgcttaactttattcctaagtgttttattatttttaatgctattgtaaatgtaattatttttttaattttcttttcagattgttcattgttagtgtataaacacaactgatttttgcatgttgattttatatactacaacttttgttgaatttatttattagttctgacaggtttttgtgtgtgtgtgtgtgaaatccttaggagtttcttcatataagatcatgtcatctgtgagtagagattattttatttcttttcatttttgattattttatttctttttcttgttaaattgctcacactagaacttcagtacaatattgaatagaagtggcatgagtgacatccttgcctcgttcctgaccttaggggaaaagcattcaggttttaactgttgaatatgttgctagtggtgagcttattggatatggcctttattatgtttggtaatttccttctattcctagtttgttgagtgattttattatgacagaacattaaattttttcaaattctttttctgtatatcttgagatgatcatgtgatttttatcctttattctgttaatgtggtgtatcaccttgattaatttttgtctgttgaactatcctttcatcatagggataaattccacttggtaaaaaagtatataatcctcttagtgcgctgttgaatttgatttgttaatattttgttgagatttttacatgcatattcatcaggaatattgacttgtagattccttttcttgcagtgtctttttctgcctttggcttcagggtaatgctagccttatacatgagtttggagggggcccctcaaccacttctcaattatttggaagatttgagaagaactgttgttaattcctctttaagtgtttagtagaatttaccagtgaagccattggtcctgagtttttccttgttggatagttttttgttgttgtttttgtttgttatgtttggtgttttaactgattcagtcaccttacttgttataggtctgttctgatttttcatttctttctaatttagtcttggtagactgaatttatctgtttcttttagtttatcccatttgttggtgtttaattactcatagtaatttattataaccctttatatttctgtggcatcaatgtctcctctttcatttctaattctcttcatttaactattttctctcttttcttagtttagataaatgtttatcaagtttatctatcttttcagaaaacagctattagttttggttttttattgtttctattctctattttatttatttttgttctaaccttcattattttctcctttctggtagctttggatccagtttggtcttttcctagtttatcaagttgtagaattaggttgattatttgagatctttctcctttttaagatctttcttcttttttaatgtcagtgttcattgcaatatacttctctcttactactgcttttgctgcatgccataaaattgggtatgctgtgacttattttcatttgtctcaagatatttctaatttcccatttgattactttttaattcagtggttgttccagagtgtattgtttaattttcaactattagtgaactttctaggttcattttggtatttatttctaatttcattccactgtagttagaaaacatacttttgataagttagtcctcttaaatttgttaggacaagtcttgtgacctaacatgtaatctatcctgtagaatgtactgtgtatacctgagaagaaagtttattctgcttttactgactggaatgatccatatttgtttataaggcccatttgttttatattgtgcaagttctctttccttattgatcttctgtctgaatgttctggccattattgaaagtgggtattgaaaggttctactgttattgtgttgctgtgtatttctcccttcagttctgtcaatgtttgcttcatatgtttagatgctctgatattgtatacatatgtatttataagtgttatatcatcttggtgaattgacctttttatcattatataatatccttgctcttgtgacagtttttgacttaaaatgtattttgtctggtataagtatggccatcctgctctatttttttttctttttgaatggaacatgtttttttttccatactttcagtttcaacaaatttgtccttaaatctgtatagtcttttgtaggcagcagataattgtatctttttaatctactctgccactctatgtcttctgattgaggagtttaatgcattcacattaaaggagttcttgaaaaggaaggacttctttttgccattttgttgactgttttctttcgtttttgtagtgcttctggtcctctttgtctcttttgatatcttcctttatgtttcattgattttttatagtgacatgcattgttttctttctcatttatcttctataaatattatctttagcattaccatggggcttacataatcatattatagctttaatagtctattttaagctgataacaacttaacttcaatcacatacaaaaactcttcactttaacctctgtcctcctctaccctttatgttactgataccacaaattacatctttttatgttgtgtatcaaatagtatatttttatagttattgctatttttatgcttttgtctttcaacttctaaaccagaattaaaattgatttatgcaccatgcttacagtattatagtattgtatatttttaatatatttatctttaccagtgaactttatattttatatgttttcagtttatcatttagcatctttcagtttcaatttttagtactccattagcatttttttgtagggcaggtctagtggagtggaactccctcagttttgttcatctgagaaagtacataccttcattttttaaggagagttttgccaggtataatattcttgtttggcattttttaagctctatgaatatatcatccaacttcatttttgactgcaaggtttctgctgagaaatccactgatagtgttatgagagttttcttctacataatgattggatttctgcttgctgctttcaaaattctctttgtctttgaattttgacagttagattatatgtgtcagtgtggacttccttgggttcatcttattggggattcatttgccttcttgaatctgagtgcatttttccttctccagatttgtgatgtttttgttgtttctgtccagtaattttttaaataaacttttttttcttttctctctatctctttcctctctctgttctcccctgggactcccataattcatgtagtggccagcttgataactttccataagtcacttgggctttcttcattctgtttttcattcttttttcctttttgctcctctgactgtataatttcaaatgacctttctttgggttcgttaactcatatatctccttagtcaagtcagctgttgaaccattctagtgaatttttcagttcagttattgcattcttcaggtgcaaactttgttttgctttttaaactatatcttctatatttttgtctgcggaccacatactgagaactgctggtctcagctgctgtaacaaatatacccaagaatacagaagatcaaacaagatatttaataaaataatatttgctcatgtaattgtctaatgcagtggttctcaactaggggaaattttgcccctcagaggtatttggcaatgtctagagacatttttggttgccatgactggggagagagaagttactggcatccagggatgcaactaaacatcttaaatatacaaaacaatctcccagaacaaagaattatctaacctcaaatgacaagttgaggtacagaaactctggcttaaagatgggagttgaggtgaggaagatggttatctcctccgcaagatcatctaagggctgaggttccttcttttctagttgtcgtgttgtttcccaaggagttgcccttgtctacagagtaagtcctgcctcactgggataacatctacttttttgcaagaggaatagaattacatgagcaattaggtaagcaaatatccttttatcttgtttgaccttctgtattcttgggtatatttgttatagaagctgagaccagtggttttcaaggtgtggtctgcagagaaccttataggaaatatctggtgtcaaaactatttttataataatgctaagatattatttacacttttcactgtcttgacatttgcaccgatagtataaaatcaatgtctgataaaactgctggctgcttagtacaaatcagctgcttagttgagaacaataaatggactcaagaaaataacgtggaagttgtacacatccttccatctacttacattccattggtaagaacttgtccaaatggtgaggctaagaccttgacatggaggaaggagtccatttaaaagggaaattcagggaatggtttctggggaaacactggcaatatctgccctgatagagaaatgctttaaagcttttgaaggcatgctcaaagaagtcagaggccttttatcatagaacaacttgaaatttttatttatgtataataatactttctatatgtaaaagaaacacatttcttgttatattttgcaaacccatgacttacaatgaatttgccattcactttctggagacaattaattcctcggggatataataaatattcttgcccaaacgaagaatgtgttactttggaagaggtcattagcttctacaaaatgtaagtaagctgatatcttactggtttatgggacttatctttgggctttattaaaatcctgcatttttaacttgaaaaagaaaaggaagacagacattgacttactgtcaaaatcaacaaggtctggatgaaggccccttgaaagtctcatccctgtgagccggtaaacatttatatctaatttgaaatgagatgcttaattacataatttcattccaattaagctgctaattaattgacagggcacctttgagagctttacacagtgcaagtaaaaggcaactacatcttgagtctattacctatgaccgtttgggagagatcagtaaataactatttaagaggctggagacagagtttgcaagaagagaaaacaagaggctagccctgggagatccagactcaggaccagtcctggccaagactcttttgagcttttttttcagtctatttcttgagtgagtaatgaaaggaaacaaaagaaaaaaaattctcttactgagcatttactacatgtatgtgctaggaagctgcaaatgaaaaatgtaagatgctagactatctgcccagttgttgttttaagtaacactgttgtttgggcattaagtaagtagttttgctatctccctggtatttaacttagccaggtctttcttcttgtttttccatctctgagctttattctggggtcaaattaaagcttattttgtgtacagatcatcaatgtctatttaatctccccagagggtagtaatgcttttgttgatagtgaaaacaattccaaattgacatcagtttttcaaaataaaatggattattttactacttgcatactgcagcttattagagtagaaacatataacaataaacatctattcatacacacatgcatgatacttcacttgcctgcactggagaagaaattattggaatgtatctttttcatccagtttaatgcagaagcagaaacctagggtggacaagctggttgtctcattactgaacattactgttgactcaagagtctttccacattacttcagaaatgctccaggactgcattatcacatctttacatctcatcattggttttattctaaaaaattaatgaaacaagttcgagttaggtttatcattcaatctaaagagtttcgtgtagtatatcacccactattatcacctagtccataactggcatcatgcatctttttaaaaatattatttgaataggtacgtttcctcacagatatatcaactattgtgcatatctctagttctgattctagttaatcaatatcagcagaaagcttatcatttcatgtctaagtgtctgtgtgggcatgaaattgttaggaattgttttagtgaataactgattcaaaaattcattgcttaaaaacaagatttttttttacagaagcattcagaactccaaagagattataactcacagagaattattttaaaaagcagataatatcttattccttttttccacacatctccacataccaacttaaatcttcaccagtaaagaggaatccaggggaaatcataagagaagcatctttgctatcctcgctgaagtgagagacagtgaacttttcctttgctcatactcagtgcctagaatcacctaggaaagccccttcccatgggaactcagcagccatgagcaagctgcccttacaggctccatcctggtcactgacaggttactccggctgtgaccactgaggtccacttccactaatgcctcagaattttaacctgagcctgacaaatttgcagggtatgtgggcacacattactgtatattgcagctggaatgcaaacaaagtggaccttaatggcaattaaatcccaacccctcattgtacagatgaggacctttaaatgcagataggtgacaagcaaatatttggttgtggtcaatgttaatgttgaattgattacttaatcaaaaatcacgagattgatccatatttagacaaacatctatgggcttacacaccgatggaatttacaccttatgtatctgtatacattatagactttctggacattcaaatccctttcgtagaagattctgaggctttgagatactggactctggtctggtaagacttgtttctctccacatggtactgccagctgtaacacagggaatcccacttaggagcatatgcagggaaaatgatcatcactttgccaagccctgttttatccttacttcctggcatcaaagctatcttacctgatcttactttccactagaatagagcccaatctaggccatcacccaaaaactggaggagactttttggtagatacttgtaattgagtttattttcatatatttagtttaatgcaaaatataaattaatgaataaaataaaatattcagaatgtctttttttaagccaagatgataagcattccttagaatgtatgtgatggagtaatatgacacatgtggactagaatattactgaggccgccaacagagatggcaacactaacaaaagtatggcttaacattcctaaagctttgatttgttgccttcttgagaggaggtagttttaattcgcttcttatatgccattaaggcatcgttgcctctggatatttatgtttacttatcagtttatgatagctattgatttttaacagttattttaaatctcttgaagaaacacatgcaaagatattttcaaaattcatagtttgctgttaatcacttatgtcctgaaactattgctaagcaaaagttttcattatttgttctttgagggagtataaatttaatttagagtgagaaggataaaacccaggattcgtcaccatcatttcaaaccagatactgtgattttttttgcggggaagaggttgagagaggcttcctggtttgctcctttgttgattttcttacatatttgacagtgtcaacattgaggctcaccagatcactgccaaagcccattgtgaagagtggctgggccagtgttttaattttggtatatattgaaaggatcgtattctataattgactatgttttacttagatggcattactgaatgtacattttcagaatttattttgaagactgacatcatagaagaagctcatctagaatactatgttcaagcctttgaaatactcaaagaactctatagattcagtgtaatccctatcaaaataccaatgacagtcttcacagaaatagaaaaaaaaaaacgtaaaatgtatatggaaccacaaaagagaatagctaaagctatcctaaggaaaacaaaactgaaggaatcatatttcctgacttcaaattatactacagaggtttagtaaccaaaacagcatggtactggcatacaaaaagacacagacatcaaaggaacagaatagagagcccagaaacaaatacacacacctacagtatactcatttttaacaaaggtaccaagaacatacactgtagaaaagacagtcacttcaataagtggtgctgggcaaattggatatatgcagaagaaggaaactagacccctatctatcaccatatacaaacatcaaatcaaaatggattaaaaagttaaacctaagacctcaaactatgaaagtactacaagaaagcattgcggaaaatatctaggacattggtctaggcaaagattttttgagcagtaccccagcataagcaaccaaagcaaatggacaaatgagatcacaaattgaaaagctactgcatagcaaaggatacagtcaacaaagtggagagataacccacagaacgggagaaaatagttgcaaactactcatctgacaaggaatcgataaccagaatatataaggagctcaaacaactctataggaaaaaatatctaataatctggtcaaaaaatgggcaaaagatttgaataaacatctctcaaaaaaagacctacaaatggcaaacacctatatgaaaaggtgctcaacatcattgatcatcaaagaagtgcacattaaaactacaatgagatagaaggtggtgtaccagaggctgggaagggtagcgggaggctatgggagaggtgagggtggttaatgggtaccaaagcaaatagatagaatgagtaagagctacaatttgatagcacaatagggtgactatagtcaataattactttattgcaaattttaaaataactgaaaaatgcaattggattttttgtagctcaagaataaaattaaagaacatggagaagggcaaaaaaaactaaaaacaaaaattaaaaattttaaaaagccatgaaataattaagtaaactggatattcacataatgaaatggctacttttgaaaacggtttaattttatataaatataaaaggtagcctcccacttcccttcccagcctctggtaactctccttttactctctgtgtccttgagttctgttttgatttttaaatcccacaaacaaatgagaatatgccatgcttgtctttctgtgcctgaatagttttgaataactctatgagaaaataaatcagagattttaccaaaataatagagttaaacataagatttttcaaaattttgtctcttttctagtttccttaataaatgtgtgtgttgttatatatattaagaaattttaggccaggcacagtgactcacacctgtaatcccagcactttgggaggccaaggcaggcagatcgcttgagcccaggagtgcaaaccagcctggccaacatgaggaaaccttgtctctactaaacataaaaaaattgggctgggcgtgatggctcacacctgtaatcccagcactttgggaggccaatgcgggcagatcacgaggttaggagttcgagaccagtctggccagcgtggtaaagccccgtctctactaaaatacaaaaaattagccaggtgtggcggcatgctcttgtaatcccagctacttgggaggcttaggtaggagaatcgcttgaacctgggaggtggaggttgcagtgagccgagatcgcaccactgcactccagcctgggtgacagagcaagacttttctccataaaaaataaataaataaataaattagccagatgtggtggcgagcacctgtaatcccagcttcttgggaggctgaggtagtagaatcacttgaacctgggaggtggaggttgcagtgagctgagatggcatcactcaactccagcctggacaacagagcgagaccccgcctgaaaataaaaaaacaaacaaacaaaaaaaacagagaaattttgaacaagatatagacgattccaaaaggagcaagcaatatggcatgcagttcagaacggggtcttccaaatacaggccctgacttggtcattgcaggccatgtgtctttgacaaaacacctttgcccaattacttttatagtgaaaaggggacaataatagtgcctactttctaaagttgctgagagggttgcattagaatgtcttcaaaaagcttatcacattgcctgtcacaaagtgatattaatgattatgttcataataccattaaaaaatttattactttctaagcaggaaaaaaaaaattcaaatttaggacagtcccataataagaattaatttattttaacaaataaagttatggcttttgttttaaattgaaatagataatttaagtactttctcttaattattttataaaatgtatggtgttttaacatatgcaaagttgatatcaattctattttcttaatctctcaaagttgccacattgctatagaaataactgtaaaaacatgtgatttttccttccacttgtatctgaacagcatttactcatttaatccaaaagctgaagagatgaaaaattgggagatagtggtttcactgttcacagacaagctttcccactggctctgtgacctcaaacaaattggtttactcctctgtgcctctgggccagtgaggaagctttcagctgccaactagggaagaaactcctgagaatgccttcagcaagagcgcagccaaggcagagtagctccagggctggttaattcagttactcaaggacagtatctaagatctaaggtttcctcccaactgtatttcctgcattcctccgtatctgttttcttctcatttttcccctcatgcacacatgttggcccaggcattacccacagatataactctagtagagacaggaatgaatatgtcttttctgttgtatgcttcgtaagactgagaatctccttcctacaactccccacctcaggatctccctgacgtggcactattcagaactgggtcacatgtcacccccagtcactgccaagaatagtgagattgctttgcttggttaaagcaggatgagcttgttagagtggttagattaatcaggatttgtctccgaggtggagaaggtttcttctgtctaggttggacagtttagcaacatttactttaggattgaattgacttgagtaacaatgcacaacatctgctgaatccttaatttttttagtctataaaatagggcaaagttcagttttatctaggtcacagaatttttaaaggataaaatgatataatgtcagctcaggcagttcaagcaagcctatgactctcaaatgaacagtggtgctttcatgataagtctaagaatccttggccaattatgtataaatgcaaccctagtctctccttcatctcctttcccactgttcagccatggctttcagagttcatcatttatttctacattgacagctaccccaatccccattccaaattcacatgatgataaaatgtacaaactagatgacttccaatcttcttattttcttaacaagtttgcaggagccattaataatgtagagcaaaatgcagtctcaggtgtgtataccaccaagatgtaacttacaaaggtaactctacaagagggaacttcattccatgttgtaaaactaccatgtattccttctgtgtaagtgggcacagggagaactcaaagtgtttatggcttagcatgcatgctttcttaccaaacactgttcttgtcccttgttgtggccattctgagttcttttatgcaaatgtgacccactaagaaggattgatttgtgctcaggcctcagccaatgcccattttcttatgccctgggatttgtttcctagctgcctctggccctgcggttgagggttcttgccagttcgattctaatacatgaacactttcctttcattctctctttctgatttccctttgcatttatctgctcccatcaatgcaaaatactgaatggttcaaattgattttccttctcaaaacaggaaaggtctgtttttcaaacttccgtacttcctaaggaaatgtctctgatcaatatgtgtaagaattaaggggaaacgccagactcccccttctgattgtcagtaactcagtgcaacccgtttacctcttaggattcttcccagcagaaaacgctaacaattgcaattatcaccattatgcagtatgttcaattgtacaatcaatgtaattgccaaatggaaattatacaataaatataattgctgctttactcctgtgcagtatttcagtggcacttcacatttattttgtcttttaattagtaacaggtataattgcagcactacactcagagctgaagctgaataatttgtgggagtgggcatagggtacagatattgaaagagggctgctgtggttcattctttgctggaattatctaaagatatccacctattgtctaaaacccacctaacagccctaaattgagctgacctgtggacacatttggtgtaaactccaggtaaaaaaattccctgcagttcctgaggcacatgactttgccatccctgctcttgacttcctgcatcccattgtccctattatttgtctatctagatgaatgtattaattcattgatttaataagcatttattgagcactgattatttacctgcaggagatatgtagtgaacaagagaggcatgaagcttaaaatctaggggaaaaatgcagagactacataaagagcgaatcaagtggtaggaaatgtaaggtgattagtgctaaaacatgctaagaacaaaaagttattatgacgtcataatatcttttgatttgatggtcagggagaacaactttccaagacatgatattcagcttgagatgataaaatgaggtaggttgttcaagtgggggtggaagaaggaagaaagtgagagagagagagagagagagagagtttgtgaggtgtgctggaagaggtagagagagaagagcttagatttagagggtttccacattataataaagaattagatatttattataagtgcaatgggaaaccaatggagagtttggtgcacgacagtgacataacttgatttctattttcttttactttttagacggagtctcactttgttacccaggctggagtgcagtggcatgatcttggctcactgcaacctctgtctcctgggttcaagcgattctcctccctcagcctcctgaagagttgggattacaggtgtgtgccaccatgcccggctaatttgggtatttttagtagagacagggttttgccatgttggccaagctggtcttgaactcctgacctcaagtaatccccctgcctcgacctcccaaagtgctgggattacagaagtgagctacaatgccagaccttgatttccattttataaaaagtctattctgactgttgtataaaaactgattgtagaggaacaagaaatgaaagaaagcagatacagagaaaattgtcagtgtctgggtagaagtttctggttgctagacctaggatagttctggtggagatgaaaagaagtggagtgattagaagaacatttggaagtggattgccattgctggttgacagaattgatgtgaatggtgagatcaagaatgaaattccgaatggtgctaggcttttggcttggaagttactggaagtctttaaaaaagaacagtcttattagtaagaaaacaaagcttgttccatttgaaatgccattagacatccaggtaaactattggataaataccctaaggggagtagtcattaccgtagatataaatgttgaggcttaacggcattgacactgaataaccctggaccagggtgagataaacatcaggaacagaaaacagaagagatctcaggattgagttgtgagtttttgcaacatttagaggttccacagcgaggaagaattggcaaagaaaattgagtaatagctgctagtcaggttgaaggaaaactaggaaccactccagccaagagaacctttaccaagaagagaaaccttaacgatgtgaaattttactgagagtaagaagaaagcaaagctgtggtctttccatttggtaatgtggaggctgccactgaccttgtcagaacagctttagtggagtttttaggctacatatatgatatgtgtgggttgaaaaaaaaatgaggtgaggaaatgaagacagcatgcacagatgatttttggagtgctgtgacaaagaacaagaagcccagttgtaggtggaggggcacatgggtcagagaggctgttggatatttttgtatgcaagtaagtgtgaaaagtgagaaatggatgctgcaaggtgggaggtggagtgctttgagaacaaagtccttgagtagatgagaagtggaatccagagtataagcaaagaggctgcctcagacaggaacagaggcttgtcttcctctgtaatgggagagaaggcgagagtgtaggcatggattcgggaaggtcagtatgtgacagtaggaggactgctgctgcctccccgtagttcgtgatctagaggagagagactcattgtacacagctcactacatgagtcagacagtggtctgagcagacagcaacaactgctgtgagagggcaccggtgggaggactctgcctaccaaagtttgacagtgcaggtggcatctgactttggcgttgaataatagatattattatcctgttatttgacttagacatcaacaggtataagggcatttcctctagaaggccgcttgcgaaagacctcgtatcaagaaagactaaggaagacatataggttgatctctttttccacagaaccctctcaggcatcagtgctttttcaaagccctgttctcctttgaaaacttcctctctccctttccttggctattttctaattatcttgcaaggctaagttgaagtgttcctcttccagaaaaccttcccagggcctacccccaaaccccttatcaatttgagttagattccttcctagatgtaggtggagcaaaaagatagtggcctctattttttggatgtgttggcatgagtgttggctttatccatctggtagaacaagaagcgtccatggtggtagccactcaagagctcaggcaaaatggtattctgagccccagagggctagattgaaggctgccaaaagagaacagtgtttgcaatcttggaaaaaatccttgttcatgtttccatggacacgtgcagttgagtccagctttgcacttcactttggtcaaagagtattttgatgtgtatcatgaaataaacatacaaataataaaaatcataaacaaaactctcagcatatgggtcagaaatcctactcagtttgtcatttatggtgggactcaagtactatcagcaccaactccacagcccagggatgaactttgttgtggtgtctgataggaaagttcaatcgaacaagctccccccaccatatctctataaaacagtcttatgctatgctatggaaaaggtttcagttatttgtctgaatatggtgggaggataatatcacctgcaccacagatacccatgccccaacccccagaacatgtgaatatgttatttgacatggcaagagggaattaagtttgtggatggaattaaggttgctaatcagttgacattgaaatggggagattatcctgcactacctgggtaaaattaatgtaattacaagggctcgtataagtaaaccagagaggcaagaaagtcagtgtcagagggacacagcatgaaaaggactcgactggccatttctggctctgaagacaaaaggtggctgcagatgaaggaatgtaggcaagaaaaggcaagaaaatagatacatcccctgcagtctccaaacggagcacagctctgctgatattttgattttagtccaatgagactagtttcagatgtctgacctgcaggactgcttttttgtgtgtgctgttttaagccataaattttgtgaacatttgttgcagcagcaatagtaaactaatatccagtgtgatgtacctctgtgcctgaatctgagactccatctaaaacccgtgcacagtcacagtgtataaatgggtgacaagatgaaaacatggcgggattcataagcaaaatgctgtgcctcagaacagtgccctttcagtaaggggatactaaatagatgacagtttttaaacagaacccctcagaacttcagtttcctcagcctgacatttggggtagtaacacatttctacattagaaggagatgtaagtaagataatgtgctatgaatggttttgtaaacatttataaatttccttgtaagatctctgcgatgattctaatactcttttgaagcactagaaagtacactggcctgagaaatgcaagagctgggttcaggtctcactttcaatgcctgtggcattcattacacaacccaatttatctttctgaagactccatttgctcatcactaaaatatggataaaaagatttagtcaactatgctaaaaggtaataataaaagtaaatgcacttttatttatttccactgtgtgtgcaaataattattaataaaatatgtcaccatacttacttctcattcttggtcaataaaacaatatccacaattccagctctcactgtacaaggtctctacatgagctacagtgagtgagtgagtgagtgataaggaagagggtgaatggcaggtgcaggaatgcccatataattggtgagctctttctccagccactgtgtccaggatctatgctcagatcttaagacaatccctgtagtcctcggtagaaagcctcttaggaatcactctttcatatttagatttattcctgggaaacttaaagctacctcaaacccagttcttttgctcagagttctcaacacaattctctgagttgtctagtgagtagaaatagaagccagaggttcatggaagtccataaacgcagtgtacatgttaagcgtttaagaaaatgctgtccgtcttgaaagcagatcaggaatctaagagtcagggtcattctctgtgactgcagtcaagatgagagcaaccaactggccctcacaggaagttttgggaggcagaaacttcattgattcatctaccttcagaatttcacatagcaccaggcacatagcaagtgaatgaatgttttatttaaaggaaatctgctcttttgaacaatataagtcttatttttttcaaagagatgtgtgttatcaaggaacttgatatgcccagaggttaaacttagttttctgactgccatttctatagtacaaaggctccagggtgctttctgtatggattagatgttaggcacacaactctcccaaacaaaactaaaaattgttccacaaatgtggaaagtatagaaaattaagtaatatatgcaaagtgatgagaatggtacacagaaaagagtgcaatgtgtttgtattatgctatgtgatctggcataggttcaattatattttcattgataattttcctataaatccatgctttggaaaatgacctgtctttgttttccctaaaggtaatgttatgcctgtatttgtgtatcttatcctagataaacaacaccagatgttgaaagagcataggaaggaccatgtgatatttatcttaagataatactagaagaagtgaggctattctagaacttaattgattcctgataaatctgagaaacaaaaattttgagtccttaagctattcatgatttccatttaagaaaaatttgtctctattttcttatttcccaaatatgttaattattgtaaaccaaatagaagcaataactgaattcttcattaataaagctgctttgtttaaatggctgtcgacatcttatattattatatagaatattatggtgacatagtcttatcaaaaaagagaacatttaatcacaaatttgtaaagcaactggattttgaaaatccatgaacattttgtacacaatagttgatgttaccttatgaaaaataaaaccttacatggttgttccattaaaagcccctgcttctaatacatagctattattttattttcattaaaaaatatggggacggaaacactgaaaatatcacttgaagataggcacagcctgtctggtttcttttatggtttttcagattccaaacggaagaaaaagatatataaacactacttccttgggtggcagatcaaataaaggacagttttgtttttgttttgttttgttttgttattcttgcaaaagctcttagtgaggtagaacaaaataaaagatggtttaaaacaagagaatcacatttatattgcttggctgtcttatttgtaggaaagaagataaattctttacagataggtaacagcactacccggtgctgactatttgagtgggatatatttccagttcattaaaataagcaaaggtgatttaaaaaccttcaacttcttgtacagtcacacttatcaacctaggttaattgggagaaaggccatatttctctctgaggtttaaaaaagtgttgtttcattcatttattcgctcactcattcattcaccccctcttcaaattcataaaacatcagttcgtgcaaggctatgattctaactaacgtactgaaaataacttaaggggccgggcacggtggctcacgcctgtaatcccagcacactgggaggtcagggtgggcagatcatgaggtcagaagttcgagaccagcctgaccaacatggtgaaaccccgtctctactaaaaatacaaaaattagccaggtgtggtggcacacatctgtaatcccagctactcaagaggttgaggcaggagaatcgcttgaacccgggaggcggaggttgcagtgagccaagatcacgccactgcactccagcctgggcaacagaacacgactccatctaaaaaaaaaaaaaaagtacaaaaattttctgggcgtggttgcatgcacctgtaatcccagctacacaggaggctgaggcaggagaattgttggaacctgggaggcagaggttgcagtgagctgagaccttgctacccctgcactccagcttgggtgacagagtgagactctgtccggaaaaaaaaaaaaaagaaaagaaaaaaaaataactcaagtaacaataactaagagtatatactaattatttaattcattaatcaatttgttcatttttattgcctattatgatgtataattccaagtttctcaaacctaaaccaaaaatatgaagcaaatttgtagtgcaacctggaagcttctctccctgcactctaattctgatatgttggtgcagctctgcttagttcaaacatgttctgggagctgaggtatttaatatagttcatgctttaaataccagataggttgggaaacactttcatttgaaaatttatgtgaatatataaactgatctgttaatacaccaatttatttatgcaaatgtgtatttgtggcccttaaagtcaattttcttaaatagaaatagttttaggcagtttatgtaaaacgttgattttctcatccatttgcacttacattaacttctgtatggtgacacaataaagatagctatttgttacttggtaggttagcacctgtcatcaatatttggagcactgcctataaaaccagacttagataagggtcaaggaagctatctacacttggtgcctacaatattaagtttttctgtatcaatctaatttccagattacatttctttttttttcatacagtttaacgtctgatgcccgctatctgtgttattgagagtgtgcatgtgtgtgtgtgtgcgtgtgtgtgtgtgtgtgtgtgtgtgtgtgttgccaggaagtagaataaaggactatattcgtatcagagcacttaggacatcactgtggagattggtttattccttcagcctcagtatccttatccgaaaaatgtacataattacacatagggttgtcataagggttaaagtcactctttttcaacaaatttttattgagcacctccttaatatcagacactattctaagtactggaaatacaacagtgaacaaaacaaaatattgcataaatgacaatgtgcattcttagcattgtgctaataaattaatcttcaattattagtgcaattggtgttgttgttgaggtagtggttggtagcagtagtagtagcagcagcagtggttcagtaatacttactgactcctgtaccagactggatatttcctgacacactgatatgaactcctaataaatagtgcctactaaatacctggcatggagaagagatgcacatatttgttgaattgaagcattgactatatgttttcatgcatatttttgtaattaacaaatgaaagaaaggcagaaagaggactaggatgaggaccatgtgatggaattactcagcctgcttatttctcacaaggaatgaggggatagggatataggaggagattggtggcatcgatgtctaatattatttggcaaataaatcaatgatgggttctaactctatctttacaacaaacctatgacgcaagaggaagagagaaagtaagtcgcatgcccgaagtcaagcagctagtactgcaatgaattcagaaaagaatcaggcctgttactctccgaaggcctttctctttctttatcctctgaagtaaagctgaggactgctttttgggtgaactaacacttaggagttgagagtttcagaaaaagggcttgcaatgtcatgtcctattgccactgaagaagaaaaaggcacaccaacttcacactcagctactccaagttcagtttcaattaaacataaagagacagctgggccgggcacgttggctcacacctgtaatcccagcactttgggaggccgaggtgggcggatcacgaggtcaggagttagagaccagcctggccaacatggtgaaaccccatctctactaaaaatacaaaaaattagccaggtgtggtgacaggcgcctgttcttccagctacttgggaggctgaggcaggagaaatcacttgaacccaggaagtggaggttgcggtgagccaagatcgcaccagcgcactccagcctggtgacagagtgagactctgtctcaaaaaaaaaaaaaaaaaaaaagacagctgtggtttcaggctggaaccactggagccagaggggcctctagaaaggcctggactccatggccagagggaaggagtttcacaaacaggattttgatagcactttagccaacagttctttggtgttctaatactgcttgagaatggttttgatgtctcataaggggttacatagtgagttatctgaaatcatttctgtctcaaactgtccagtctcccttacggtgctttagtcaactcttcgtcttctcagtcttcatgttaaaaggaaaaatcttagtgaaatctactacaggagaccagctaatttcttgaacaatagtgaccattttggtgagaggcctttaatagcggtattgagaaggcaaaccttcaattagaactgaaaaagttgtctttttttttagcaggaaactggtaaagggggtatctttgcacaaaagcagtcatatcagcaggagacattgtaaaattaaccagtcaagatacctttcaaaggtaactattaagaaagggaaaccatgtaacacccacctttcagcaattttttctgtaacattttattaagtatcttttcttaaacaaatgcaaagtgtattttacttcacataaatttgacattcatttcatcgttcattttgtgtctagtatgtaagaaattatattcaattctgttgaggatttagagaagagagagacacagcttatgccccacaggtacataaagtttagatacgaagacaattgatatacacccatcaaaatagtagtaatcaaaggaaaggaagaggaagaaacaggtatttcttgaagacctactgagtacctgccagatacttattattgttttcattttaaacaggaaacagaagtttagatgggttgtgacatttgcccacgttcacacaggtatagatttagagataagactcaaattcaattctgtctcctcccagagccagcactgtgttcactaagccccctgactcacacacatgacacagggatctggagatctctgctgaggtgttgaagctttgaggaagagatagcattttatacatgcattggagatcaagttgtaacaaatggaattttagtacatagttattccagatcatcatcttatggattgagggggtaaatgaaggagcatgtgagtcttccttggtttttccctgaagtatttgggaaactgaaggcaaaaaaaatccaaagtccaaagcgtgcgtaagagtcgttgccacttttgagagaataagtctgtagatacctttttacctccttcggtcaatgaataagtgctactgagtaaacttacattattttctattttacaaattacactatcaatattacttggaaatcctgttgcctatgtatttctacacagatcaaagcttttcctgtggtcggaatgctctgattgaatccacaaatcttactagttgaatcaaaatcaacggcttaaatgtcaggatctctatctgaggagctgtagacccctgttgaggttttttttgtgtgtgttgttgtttgtttgttttttaccaaagtcccccgaaagatgaagagggcattgtcttgtaaaaggagggacgtgggaagatctgactagaagaaaaacatgtgtcataaaaattactgaatgctattagactatataaaagtcagttcttaaaagtcccttagcaaaaaagcacatttgtggacaacaagctgttcactttgattgatgtgtgatatacacataggagtatgtgttagattaactggaggcacattagggaggacatgaatgtcaggatgaagaagttggagtaactgggaataatttgattattttgagcagagaagataatcattgcagctgtgctttagaaagaccatctgtgagtcatgtgtaggacggattatagaaaagagtgaagacacagcaaccagccaggagactgttgtaaaccttcaagcaaagatagcaaaatttcagattaaatcagtggtgatgaaaaagaagagcttgagttggattctaataaatactcattggaaatgagtattccatttccatgtaaatggacagtaggctacaagtagcggataaagcagaagaaagcatcaaacacgcctcctagtacttgagcttgagaaattcagcttggtttgagtttgcatatagtgaatatttaaaaataaaagtagcttgtactctttcacataggaattacaggatgtagtcactatggaaggtcagttcactgtcttttaagaggcttctctcagtagcattgctttttctggtgaattcagcataaagactaggcttagaaattgactttgtctggaaattaaaggcatatcattttttcaggggtgacttcacattaaaaactatcataagacatataaaattagaatgcaaaattagtacattataataaaaaataattaatggccgaatatgaatatgtttagcttccattcttactttaagcataccttcatgggaaattacatcacataaatcaaaaacaggatgttctttgatgaacaaggaatcaacaatgaaagttggatgggtcaaatatttaacaacagccaggaacatccatctgccaacagaaattctgtttttaaaaacagaatatttagcattctctaatgcagtctactgcattaagtcaggtttgcatgataacctgacttttcattatgacttttttttggttctttatttaactgaccatcagatttaatatgttaatgaatgtaaataaaatgcatcaagagtatagtaaattcttttgagagtgggcagttttctaactctttaaggtatcattttgtatcttgattcattaaagttgactgtacaatttaattctgagtacagtggtgtcttttattttgcaatctacctcactgtataacccacatattaacaggagctttatagaatctgaggggctggcaggatataaagatatacattaatcaaggcaactattgttagtttgtagtaaatagtcctaaaataccactgtcttactacaacaaaggtttctttcttatacttatcacagtctaatgagggtttgttagttctccattgactctctcccattcttcacctaggggtgttcctggaggctgccctgattagctctcatcagtgggctcctttgccctctaacttctgatttggctcagtcagtggaggacaaccactgtatatgactgaagagcaagagaggggatttagctgcagtgtttatttctgcagtgtttcctttactggcagcatgttcctattaaaaggaaattctccagtcaagtggcattcgctgtacaactctctctgtgttctggaatctagtttcttcatttgttttctcaggcctaggagtagtaatatctctccaccattactagccctgggggtattacatcattcttcattgctaggtataaaatttgtcctcacctatataagagatgtcctgtaaatctcttctcaatttctcaacttgggtgtgccatatgctgtctacttgaactttgacatgtattctcaaaacagtgaagtggctatttaagctccttctttcttgtgatgctatcattttaaacacatgctctctaaggttgctgcagaagtggagacagagtgaggatgtttgcacaaggttttgtgcttagtcctaaacatggaagacattgctgcctatatgtcacatggctccaacataactgaagtggggttttctcatagactcagacaagttgggaaataatgggatttggtgagcatttggtattgtttgtgtcgtacatggagatatgcaataagcaaatggaaatgtggacattaactcaaaaggaaggatgatattaaatacataggagaactttagatggcacttgaatgttataccaattcaaccccatcatcagttttgaccacatctttccatttcttaaacatacttcgttcccactacagatgccatcttggttccttctctacctctattttgatattcacatagaccagtactacagatttcagttatgtggttcttctgggttccatctgtttcttttcattgtaactaacagaagcctggtctgatttgctaggtgaagctgtacaagtgaaagagaaatgttggagagatgtttcatggagaaaagatagccagacagactccagattacgtccacgaatatagaagcaagaagagaactcagtaagaggtatatgaatcaggctcagtaagaggtatatgaatcaggacaatatcatcaaagacagtccaggaaggaggttcaaaaaagaagacatggacagaagtaccaaattcagggatatgtgagaggacatgtggaaaagagctctggatattcatgctcacagtcttcaccaatagtggactgaaggaaaagatgtcattgaaggctgtacagccaccacaaagaggagggagtttcagtgcaaagagggcatgcatttctttcatcttcatccttacttctttccgaacttcaattctttgaacagtctacttgctacctgcctgaatcctttcttaatcttcttcacatgtactccttcaactccagaaataggttttctgccttttctttgttaggatcacatttcatttatgttctttaatccaagtcagttcccaatcattgcttaacaagacttggcttcttattgattctctagttcagttgcaatggtctattccaaatcttctccaaacaccttaagctgccatccaccatataggccttactcaatgatgctctacttttcttccttctacctaagacaactttgctttgacacctctgtaggcctaagaaagtggcctgcaaatatgttgctattcactcttctcacctcccaaaataccaccttaatctctcctgcttaatttgcatcttcaaatatttagtttctctcttattgcttacccctttgtctcaggatctaagaacaggtttagaacagataactgaaatctccatgacctcctttagataatacctttggtctcttccccaccagagtctgacaatttactaaacaaatgaccgttctcattggtttaatagccagttcttttcattttcccctgctgcccctctgcaggaattactaataagctgcagacttgggcagtagcaggcagtagggatggctagaggtgaacagtggcaggcagacccttctgatcctcaagcagcctgcctggaagtgagcatgttgcaggaatagtagtgttatctcttgagatagatttctcttgtgtcttctaatctccccccaatgccagtgttatgtgtgtgaaccacccttgaaaaccatcttctgctttccatttggctttccctttgggctggctgtaatatttgcttgctttcctatgtcaggactctttgaatgtatacctgtatcttgtagctatctcagggacctttacaccaagctacatattaaaatagttttctctatttagtaattctatgtttcttctttatcaggatattccttctcacttttatccccaaaatggaagaaataacacgttttaaaaattaattgcatagcacatttgcaagttatgttcccgtacttagtccagtttaagcctcacgccaaacttatgaggttgatattcttacttctatggtacagacaaattaattgaggcaagaagcagctcaggcccttgtctagttgactgctgtgactcatactttctgttcttggctgctgagtcccttgctccacatttctgctttcctaattgtttttgacacaaggaaatgagaacatgttggaaaaacaatagtctttctggatgagttgttgggctaagtgacctttaaggtatgttctaatctagaggtctttggttcttgcttgattatagtgcagtactattagacaatcaatgcaattgtcctagctgaatgacagggtagcagagacagtgaaatattatttttggcacttttttagtgttatctatttttgtcgatagaaaaataaatcccaaaatccaaagggaaaatatatatttatttgcacttagtgttcagtagtgaagtgcacgggtcatttgttagtggatgaatgtgggcaagttactttacctgtccatgatataactccttatgcataacgtgggatgaataacatgtctactcatagagtttttctgaggttcaaattagtgtacacatgtaaagtgtttataatggtgcctagcacttagtaagtcatcagttaatatcagctgctgttacattttgtaaaaatagtaaagccgtgtgtagcggtccgttctcacgctgctatgaagaaatacccaagcctggctaatttataaaggaaagaggtttaattgactcacaattccacatggctgggaaggctcaggaaacacacaatcatggcgaaaggggaagcgggcatagaccttcttcatatggtggcaggaaagagaagagtgaatgagtgaagggggaagagccccttataaaaccattggatctcatgagaagtcactagcacaagaacggcatggggagaaactgcccccatgattcaattacctccacctggtgtctcccttgacagtggggattatggggattacaatttaagatgagattttggttgggcacacagccaaaccatattactgtgtaaagaacttaccacttttaagaatagttaatattaattgacatacagtatctgaccatttattacttggaaaactctatctgcactatctcatttgacctaaattatcaggtagaaacaattatgatcacaatttaaaagatgagaaaactgaaatatagggaagttttttaacttaagtctcatcgatataaattatatgaaatgatttaaaaaggtgtgtctgaggagaggcagcataactaattagcataactaatatgcgaagcctttctggactcagttttggactatgtaacaattacacaaaattggaagccttttaaatgcctttgggaataataaataaagagttgcacctggatttcatttttaccgtaatcaaatgttttatattaggtattttggaaaactactggaatgaccagcaagattataataataattctggagccactttactattattgtctcatttatacctctcagcagaggctggagcacatggggactatgccattcccataaccatatgttttaccaccttgctctttgtcctgtagatgagcaagcaaagaagcatacaaagagcatcctataaaagagcacgaacaaagacaatgtttgaggagctctgttctttggtcttcccagagtaaatatcagcaatagtaggaaaaagtgtttaaaacacgtatgaggggaaaaaaaaaaactacaggaacgtcaattacaaatgattattttcaaaaataaaaccttctagcttttaactagtttatcgcagagctaaaccaatacagtttcatgcctcataacaatttaataaatattactaaaatatggcaactgctaccatggctcattagcaagctgttggtgtaatataaagttatccagaattgttttgggtagttggtttgtcaatataatgcacacagtaatctctgaagaaagtcaggaacatatggtccatgttcatcagctaaccccaggggactgcaccagaatctctcttcttacaactacatgacgttgagaggagagcttgagagaagatagggaaaaaaagaatgggtggaaagagaaacattgattactcaaaccataaaatcacacttgcaagcataaatcaagaatcacaaagctaacatcttcaaggaatctgttaaaatacaagttgaacattgtagcatcagaaattctcagaatatgaattctgaatcttgcttggcacacagctaaagttaatcatttcagcagcagcagtaaaatgctgcatatagcatgctactggccaacataaatgaatctaatgccatctatttaccaaaatcaagattcctttgaatatattttcaataatttatatgctaagatgtacatacatattacactctctctctcaaaagaaacgtcatattttctaatttaaagagacatatcttgtccaattaaattcgtttgagtaggaaactgtagagttaacaactgtcaatgatcatctatgtataagtagaattatacactttaaagattatgtttatttaataaccatccctatttcctgtaactgggcaatcagacatttttttgacccaaaatatgaccactgcattttgataactctaacagcacaagatgaggtctggctattagagccatataatgatgggtaagtattttgttttcttgggtgctttcacagtgtaaatattatctcagaagtgggtttttagggcaattcaagtaggatgcttaggaatgtacttttctttatttggaaaattttctcagatttcatttgctcagttttatacctattgatctttcattttaattttatctaaaaacctttcagttttgcagtgtgtcacaagtctgtgtaagctgcagcttcagccatctcttccatgcaatgtcaatcttgggtcgtgtgaagcatgtggctttttggaaattttctaagtaatgtaattgatgcaaaaaaatcaaggatatatattttcaatagccaagataatagatacataatcctttcaattaaaatttgtgttaattcaaggaagggtaggatcagcatatatattatgtgtttatcaagaatactctcctgagaaaattcatgaaatgagaagtaacagggagaaagttgaaacattgctataacatatcaaaatgagaggctctgcataaatgaatttataagaaaacattaaaattgccaagtataaagactttacagatacagagttaatattacctttatgtagacatttgaggcttggccaggctctcctcaatgagtctattttaaggtaaagttattaaagtccggctcccatctcacagatattatttgaagttgttttatgtggaagcagcctgcctcatgtgattgcactgtgaagctctccagctagaaggcggctatgtgacttgaaatttaaatataaagcaaattcagtcaggtgccaaggtgccagcctgctggaccaccatattgggaggaaggagaagtggagggcagggggttgaatggagattgggttgtgcgaaagagaagatttcaaactttggggctggaagagcacagggtgctgcaagaagcaatgtgttgggctgaataattcatgatgcagtactaattttgactctggagaaaattgctttctcactgtgccaaaagctaggcagtgagaccaaaaatcaaagaggaagctaaatggaggggagaaaacaccctaaatcaacaccatatcaaattgacaaactgtttaaggctgcaaaatgtattgtcaaaacatgtgagtagatattttaaaccttacctaaaattgagcatatttatgcctacttattttgagcaataataggtagatattaaataattattttcaaaagtagctccttgatattaatgcagagagttccagtaaggaagtaagcatttgcatttcattggaacttggtaaaaaaaaaaaaaaaggctgcatatcttggtatagtgtaagagatccatcatcattttgtacttacagaatcatatgggtgccagaaatgaccttttgagctaattaacagagctgccataaatatggaacttgataaatgttaatatttattggattcctaaaatccagatggtcttccttgtcttttcattctctttggaagataatattaaaataagaaccttctaaaatgcaaccttaggcatcttttcaaagtctcatttaattcttttctttaatggttaggaggacttatgagcatttctgaggaaaagtcgctgactgcctcttaagccttaaccaagctttaaactttagggatttccactcagatttaacaacattgagaattttggtcctagatttctttttctttaaagagttctttaaagagttaaagaaacttctgggcaggaaaatacaggaagcttagaatgaagatggttgaggtgttgtcttcctcctcttctttcattttgtttgttttgctttcaagagaaaagccagatacagctctggggagtcgaaaggcatccttggcaaagaatgcaatccctccagaggctgaataagcgtgcacaggatgaactcacagatagccacgccagtctcccagagcagagctgcatttccaaaaattcactttctggcaaagatgaggattttcctgtagtggtttgcattgctgaatggggctgaagaaacaccagtcttcaggactatttggaaattatagttaacaaaatctagagagccatgagcaatccaaagtaaaattcagttgagtgtgtagagccttccacatgagagggcatggtatgtaatttgcttcacttaatacagattttggagacagggcagcaggctggtgcacagggcatattttagagggaccataacacacccctatactagaaatgcagtgtactgtgtctcctcactagaaacctaaatacagcctctgaaaggcttgtcccttgggtgacaaagattgctgaggtttgatggagtgctgtgctctcagtatggagtagggggtggtggaaacaggaggcatatattttagttctaggacctccctacatttacgagttctttgactttggaccaagtcatttcagtttgcttggctttcttttcctcatatgtaaaatgatcattttatgttagtttgaaccatgggaaatagctgatatttgactaacctataaaaacagcaatttcacatggttcaaactaataaatgctcttgagacttgttctgaggagcaaagaagcacctcgttgtagataaacacatgcatgtaaattgtgtcctcttcctgctccagttacatcatctattgaacattttgtggagtttcaatgagataatatttggaaagcaaatagtagcactcaataaaagtcagtttctctcatcatgattccacacactttaatttcaactactgttttgaacttaacacttctccagtgttttacaatttacaaagtgctttcgcataagttaactgtttatgtgatttttgcaacccagtgataagacaatgaaagttccaaaaaagttgtcacttggactgaattatccagataggtagtaggatattgcacgtcgctgagtacaacatatggtcattgcccaataccgatgtctctaaattaataaaggcaaagtgggcatgtaggcatgtcactatctagtctactaatcagaaacagatcagtggtctttaaatattttgatcacacaactttttatgtgataatatttgaaacattaatatatgtgccatttatctatttagtatacattttcagtctctataaattatatatgcatggcagatgtaacatctgatgtgcattatgaaacatacgtaagtaaaaccttttaaaggaaaatatttaaaaagtaaatatattgcaagtcctaatattttctccctgcattccaaaggattgcacaattgcagctttttaaattgagatgcaattagcacagactggtggatttctatggtctttattgcccaggccctactttcggttcccaggaacaagaaagttttgggatttgtgatcaagtcagaccagcttccaagcttagtgaagctagaacataagcatgcagcttataagggaggacccaggtagagtggtaatgagagccttacttgtagtcagagcacttactatccaaaactgtggcctcatgcagggcacaagcaccctcaacctcaatttctaatacgggtttatttgaggagtagaaaagaataaaatacaggttgaacatctgtaatctgaaaatctaaatctgaaatttttcaaaactataaactttttgagttctggcatgatatcacaagttgaaaatcccacatctgacctcatagtcaaaacacagtcaaaactttgtttcatgcacaataaatattacataaaattatcttctagattttgtgtataaggtggatatgaaacaaaagtgaattctgtgtttagacttcagtctcatcctcaagatattatgtatgtgtatatattccaaaattcaaaaggaaatccaaaatctgaaacacttgtactctgaagcatgttagataaatgatatggaacctcaacctgtattctattgaaagcacttgctaatctataatatactataaaatataaggtattatcaatgtgtttatgtttactgtgtatcccagcattttaaatactgtaggcacacagcatgagtttaatgaatgaatgagcaaaaacattaattaattaaaaataatacattaccttactatgtcacatatgctatttccagaaacagaagacacaacaaaatatgttttcaaagcaagtttttttgttttgttatcattttatataataggaatctggaggtaagtagcaccagagtcggcttattcgactgctcaaacccattggtaagaaccctggttctgtctgtcttccactgagccacgtggaggcactgggctctttctctttggctagatctactgaatttctcagacgctgccacagttccaagcagctatgaagatggcagtgtctggaggcattggaaagggaacattctgttctgacaaagtgtttttttaaaagaaaagaggccaaatattcactgagactcccttccccttaggctcagtggctggtagtatgtcgtagcccattatttcactagtccaggacaaaagcaatgatgctaataggatttctttatcttgagtttcatgtcttagggttggagaagggaccaagcctcccctgaaagctgaggggtttatggtcaagaagaaagagtaactatggccacctttaggtcaccagccaataatactgcttctctatcctgttctgctgtgacatttgtcccagcaggtgttccagtctgtcctacagtagtgagaccacctgatatggtgaggaaggcaggtaattgatcttactccatcatatcatcacatctatttccaccccccgcccttggagacaaggtctcactccatcatttaggccggaatgcagtggtgcaatcatagctcattgtagtctcaaacacctgggcccaagtgatcctcactgtagtctcccaagtagctaggactacaggcacatgccaccacacctggctaattaaaaaaaattttttttgcacagagatgggggtcttgatatgttgcccaggctggtctggaactcctggccacaagtgatcctcccacctcagcctcccaaagcactgggattactgttgtgagccaccatgaccagccccatcacttcttttgtaggtttgtatttgtttttatttttgacaaagacttttatttcacggtgacttcttcacaagtttcctcagatgctagtctgaacaaaggagagcagggaactagaaatgtagactttctgttttttccagctatggcatcactgatctcatccatcttactaaagtttgtgcagtcttgatcattccccattcccccaacatgatggcaaataccagttaagtactcatatctaaagaaatcctttattaacaggaagttaattaagaacatgtacatctctgacattcatcattacaatgagtagaaattaattttttcaatttcagttaaattttattcagcaaaaagctttaacctcttataataagatgtgaagaattatgagaaattatttgctgtatttctggaacgaatgcatttaataataggtcagatgagcaaaaatggttgtaattcaaatttgaatagagaatttcttcggtgatagcaaatggaacaatatggcttttataagtaatattttgattttaaattatttaaaatattcagatgctattctagttttaatccactttttgctttctttcccagcatcctctgaaagtttatatgctagaggtctctccttcagccactccttgatcatctccaattagaaatctatttatttttcatcagaaatgatcaatgctacaagtctgattaatatgagtggtgtgtatatgtgtgtgtgtgcacatgaattttagacagttttctgcagaatcatcttctgttactatttttcaagacaatactatgacaagccaatgtgttctgaataaattatgcaatcgatgggtgaagcaggcatttgctttccagtattatacatcccaacttgtatcacacaggcagacttctgttgacaacactattgacctatatatgaaactttgaaactctgttttacatttacaaaatttgatatttctgatattctatgggcttcactttttgacatcatgcctttgtacttttatgcaatttgataattatattcagccctttataaatagttaaaataatgtttaatcatctatggtaaatgtgtaaattccttactacacactttctgattttgtgtgtgatttgtcaggaaaaattcgtggtttgtttatattttttatgttttccttttttttttttttttttttttgagacagaatttctctcttttgcccaggctggagtgcaatggcgcgatctcggctcactgcaacctccgcctcccaggttcaagcgattctcctgcctcagcctcccaagtagagtagctaggattacaggcacacactgcacactgccactactggctaatttttggtatttttagcagagacagggtttcaccatgttggccaggctggtcttgaactcctgacctcaggtgatccacctgcctcggcctcccaaagtgctgggattacatgcacgaaccactgcgcctggcctttttttttatgttttctacacaagaccagattatattttttagaactaaggaaaaggagcacttagaaagtgtggaaaatcaatgaccttgcaatttgatatatactctggagtatactctgaaatctcaatagtttacagacaagatagtagaaattagaaaatacattttatatatatgtgtgtgtgtgtgtgtgtgtgtatgtgtctctatctatacatatacacacacatatatgcacatatatgtgtgtgtgtacacatatgtatacatatgtatgtatatatctgggtgtgtgtgtgtgtgtgtgtgtatagatatatatagatatatatatatatatacccttgtgctaagggatatattttctaatatgtattcatgtatttttataaatcttaaattttcttcagtctcatagctacagactctgtaatgttttttgttaaactgaaaataatcatctctggtgaatctttctaaactgtgtatttctaaatgtttttaccagtattattgtgtttttggaatcacattactttttagtgtagtgatagcaagtatagcgagttaatgctttttttaaattagcaaattaatgtgaagatcagatctcaaatatcaggttgtctgatcttattcagtatgccatttggcttaagaagttctcattttgtttctgcagttcactcatactgagcaaatctagacaaaacaaatcctgttgctcacttggaatttagataattgtttcacaattcaaagaaagaagttaattagcatgactttttttcaattaaaagttatttattaaattttctttcctgaaactgttcatttcctaggaaggtctagaatggaacaaatataaaactaagaaacagcagcttttactccatgtgacaaggttttgttgagggtgcctgtggggctggccatatttgtcatgtgtgtaatgtggctgtgcctctggcaagctgtaagctggtagttagtgtggagtctgcattccagctacctgggtgccatcgctcttaacacacttcttagctcagatgttccaatatttgttctcctgacctacaacattaggaccacgtgggaacttgctagattctgaggctccctcccagactttctaaattagatactctgagggtgaggcccagaatctgtgttttaatgtgctcttgaggttattctgattccacctaatgcttgagaagcactgccctagcttctgtcttgggcaacactcctgaatcagtgcctagcttttcccagctgtaaaatgtaaaatacaacatttttctcgtagaattattgtgataattcaagaaaatcatgtaaagttatttctgcaatagttgcctaacagatagagtgctctaaggacactgagcgttcttcaaaagcagtatggcctgtgtgctcccatgtctgagcacatttgaaaaccagcctctaaaattacacttcctcctctatcaatgattgcagaatcgaatgttgcaaatgcatggcagtaatacatcctttgaagaatgaagtgttattaaaatttcattccataatatttgtattagttttgtattactcaaaaggcctatcttattttactttcttaatgaaattaatttttatttcactatgaatatttttttctagcccctactttcatttccaaattttctcattttctttttagtctggatatttcctagataatttatttcaacattctagtactgtataatctcaaatacccaaagaaaatacattttttgaaatattgatgaactaaaaccaataggtatgaatgagtcgatcctgtgtttaatctacatgtgagatatcacctattctattccatgcaaataggaaggtaaatatgatgaagtcattaataataacgaaataaggctattttatataagaatttaggttatgtcccatacaaattaacagcataatattacgtgattagtcttcctgatactaatattttcctaatttattcttttcaccagctgcattaaaattcaccgcaaagattcagtccaaggttctcacagggaactaaaggttaaaatgtgtttgttagccaatatacaagactctgtaatcttatatactacattggcagggactgttgggattcagttctgttcagccatggaggacacactctgtgttgccctgagactgtggaaaatacagcgtctataacatatccccttcttacagaggtatgcatctttgaactcagaactctcctttgctactctcattcaagacactgtacagcccagaacttccagcctgtgggtttttctcaccccctttctctgcctgagccctctgctcagggtgggattttcatgatctccccacatatctttcttcttctgtctctgcttttcctctcttcccaaagctagaaagccatctcctagcttaattaccacctcccatgatcttgtctatttgttgctattaatctgaccttaataaaagtgtttcctgagatttcaccttatggacatttggattcaaagtaagggctagaaatggagagttagacgaaggatagatgagctgattgcatctagggaagtcaaggagttgggcttgcattgcagagaatggctaagaaaggagaccaatctatgggatacttaaaaaacctattaaatctgaatatctgagtttgtccattattagaattctttcactaagtgcttcttaaaatgatcaaagaaacgtttgggattgtgagaaaaacagaaacattgtcctgtgcatatattaagtgtgctatatcaaataatatttcatctttagccatcagtaacacatttgttcttagtatatatatgtcaatctaaaaagggtttctcaaccttaacattattaaatttttaggttaaatattgttttgtttgggtgtgggccgccctggcattgcagcttctctagcctctacatactagatgctggtagctatgtgacccctcaaaaaaattttttggcaataaaaaatatcttcagacattgtcagatgtcttctggggggcgtagtcatccaaactcgagattcgctggtccagactgtaaaaattatcaaactactcttgggaaagatgaatctattttaagatccacttgcaagctacatctacataaatgtccattaacctttagtactttgtgacctgattttgtgtttcttcttgcatgattattttttgggccctcaatatatatttgttaattctatttcttcagtttctctagatgctttatctggccaaatagtgtatcatagcaaattagttctagaacctcacttgtcttaatattagttaattggaattaatatttgttaattctatttctttcatttttctagatgccttatctcgccaaatagtgtatcctggcaaattagttctagattctcaatagtcttattattcgtaggtacacaatagtccaatgcattaaaatgactttccttttaatagttctacgtgaataaaaatgtatttcctggcaaatttcacctcaatgctgcaaatccattgaaaaagggaataatacagtatcacgatacagggagaaaaacttagaaacacaataagatatacatacacacaactttacgagagtaaataataagtaaagatatatatgtatacacacacacatatactgatacagatcactgcaagaaaatcacaaataccaaagtcaaccagaagacgtgagtagagaaaaatagacaacaaaacaacaaataatgcaaattaaagtgagataatcattttgctgtcaagataggagaaaaaccaagagtgggaagatattatgattcttcaatcatgtgggcatgtatctttactgtgtgtgtgtgtgtgtgtgtgtgtttatctgctgagggcctttgaatactctttccttgctcagaacaaatagacaaatatataattaaggcacctaacaatacagaccatattttcagggatatagcaactaaaaggtcttaggaaggccaactcaaatccaagcacatggattccagctggggacaggagtgaaaggagtggatttcttgtgtctgtgagcctagagtgaaaaacagcttcaggaaaccttcactttgttatgtatgggatgaaattgaaatcaagtgtattgtgttagggggatcctacaggaagaagatctgggagatttttcttgaggtttgggggcaggcatttagctgagggtggacattgaggagaatctggagggcttttattagaaatatgcttccataccttgcaaaaaactccaaaatatcacacctgtttctcaataccacatgctttgtacatgccatataactatttttgattaccaaatttcattttgagttttgatactagttttaaaattacagttatagctgagcatcatagcctgtagtcctagctactagggagacagaggcaagaggcttacaacacaagcctggacaacatagtgaaatcctatctctacaaaaaaatatttaaaaattagtcaggaatgatgacttgtgcttgcagttccagctgcttcagaggattgcttgagcccaggagttggatgctgcagtgagctatgatcataccatcacatgccagcctgggtgacagaagaagacactattgtctcaaaaaataaaacaacagttgttcaggatcattaggaatatatttaatcaatgctttttcagaaatggtggtttaaaaataagtaggctaggaaggaagtcctaagtaggtattctggtctcagacttgtgcttcctgcaacacctttaatatctataaaataattagagtttttgattgtggagtaggcttgatttggaactgaggatttttttctagacatatattttaatttgagtttcactcactgccaaaaaaaaaaattggcaagacagagaaagaggaaaaaaaaaaaacaggccacaaaatgtaaaagtcaaaagcagtcattccaaatttgtgtcttatatattctctcagactttgctgtcttctttatgtttcaacatttttcagatagcatcattaatgaacagccttccagcccccctccataatgcagctttttgatcctagtgcccaactggcttcaatcaattcctctgaccatgcagtttatgactctacaaaacctgccaggactcgtttccttagtattagatgcaggcaggtagaaattgagagatgattccacataatgctcatcaaagcagaaaaaaatcaaacctaatgcacaacagggttacaaagagaaaaagttaagcagtctgtattaaaaacaaaaggaaataacagggacagaagaaaaagagaaaataaaacaagtgatttcatgtaggtgctatagaatctttaaccaaaccacaggctctgatgaatgatctcttctgcctgagactcaggactgtcatggtccttatgtccaggaaaagagccagctcttttattgagttgccaagagttgtcactgaagccatcctgaagtttccttgcttctagttagataggaagagaaacacaaatacattctccctcgggacggacacttccaaactaaccactcccatccagtggtaacctactcccaaatcctccaggtggcctactacaccctgctttcttctgcttgcagttgcctgacatgacattgctcaccctttcttcttgtaagtgttacctttttctgtgtccctttgttatagatgtttggcctatagtggaagggccttacatttgtgtcacataaatcatgtcatgttattcagcccattacattttatgtcaagtaataccttatggtattttacctttatcaatataaaacaaatttcttttgttttaagtttttgccctaaacttcaatattatctggtgatggagtggtaaacaggctcttcattcatggagcttataatctagtgtgagtaatagaatagaacaatttcttaaataaatcaggagttaacgccgattgtgatgagaactcaggagaagtgtaaggtatgttggaaacaaggagcataagttggatgagcgatttagacaagtattccatatgggacagacagttctgcctgtctgaaggacacaaaggatgtaccaaggttatgtttctagacccagttgattagacccctgggtttctgctcttgagacattgccagaggccaaattaggccaagtccctgggtgtgtttgcctcctgtagggcatttctaaaaccaattactaccttcagatcaagaacattttctcttataacatctcttgaattgtttgggttctccttttaagaataacaagtcatccctgcaagctctttattttctgttctctgtatccaccgtgttttccctatttttgtttctttgttcttttcttctgaattctaggtagacttaagttggtcttccaaattgttggcatcaatctggctcttcagtgccccaatgtggatttctagtatgattttccgtggtaattttctgtatgtcacatatactttttacatcctaatatgtggctttattttcctgtcctgttctcttcattttgcttttggctagcttgtatagaaacatgttatttttgcatttgtatggaagtcatgttgcttttgaattgtaacaaaattgaaattttcttctggatcctgcagtagattagcagaaaatcttctttttgagaaacttaagtatttcctctcaggatttcttcagttagcaattcactaggaaacagaacccgaaacaattctttcagtgtagattctttattgaaaggcaatgcatgggacagccagaacaaccctgtctactccaaaggggagaacagtcagacgtgcctgcagccagccccagcagctgcagctggaatgccggagagccaaccaagggtctagaacatggataaagctgagataatctcagggtgtgtgtgttactttgaatgtatcagagtacttaatttctcaaaaaaacatatcacaagacaggctgtctgttcatataggtaatagtctgcaccctagatctgtatttggaagaagcttttctacaactgcaggccaattgctattcctggtgggtatttactaactcacttctgcttcaccttggccgcttttccccctggcctatcaactcagttggagagaatcagaactggacattttgaacaatggaaaaaattgatttcctcctaaatatactactagggtttttgctgcctttgtgcactcagaatgcagtgtagtaatattccagcaaccaccccaaacacacacacacacacacacacacacacacacacacacacatacacaccacccacgttcttctggatgccccactaacatatacaggcacacacttcacagacacacactccacgtgttctgcctaatttcttggtattcttttctcttataaatgtagtcaactagcaggagggcaggaataccaaggaaaaggaaccagaattctggcgcttccagaaagcagcaccttagggctataggcacagctattattttttggccagatcacaacctgtaagagatacaaagtgagtctgtttccttttctacataacctctgtcttatcatgacagaaaatgttgccggattctgggccaaagtatgaaacagcatcagaaaagccagttgtgtcatctatccagggatgccaccatgtgagaacaaggtcccctaatattctagagtgcctggcctccatgcagggacaattgtgtatttatttacaagaatgtgagcaccaacactgcagagtttaggcatttatgttcattgccgtatcctcagcacttacaacagagcctggattctaggaggtggctaatactttattttggtgaaatatttgattagagcagttatgtgattattggctgtcttcccctagactaggagttccctgaaggcagcactatactcttttctttgccaggttatcttctgcttcaggtacagcatctagaacataaaaagtaaatacatatcattttatgaataaaaaagcacttttagaatgcagaaagcagaatgactagtagtatagctgtgttcatgtctgcccctcaaataaactaagtgacctgacgatagtgactcttgtattcatctttgaacttctgacaaacccagcacaattcttttaagtaagtccttgcttactaattatttggttgaataagcaaacaaatggaaacatccataatattagcaaatatgatgcaagacatgaaaagccttatgcattgaaatctacatgacttaaccctagaaggctgaagtgataccacaccaggaaaattactaacttaacagaacacatcaaaataaaacattgttcaaatctatataattatctcaattgccaaaaaagtatctgataaaaattcaatagctattcatcataagcacagtaaaaatcataggaaagagggtttcttttttcacaggggaaaaattaaatgtttcaacaagcattacctttaatgtagaaatatgagactttctaaaacaaacaagaataatatgaacatagctcactttaccattgctgctacaattatttattattttaatagtaaaattattaaatattaaggaaaagaatattaaaaataaaatcaccagacctcacaatattcagtatacttttaaaaatgaacttgcaggaaaattgttgtttcaaatgtgtttactaggaagaaaaaaatgcaattatgtaggattatgattaagaccacaaaagataagtaaaaatgatacattaaatgctaatgtggggaaatagaagacaaaagagatgcatgttaaaaaattacaagttctaactacggtattaacacctaaaatcagttgaatatcatttgcaaggaaagaatatcgtttctttaaaaaacatatgctactttttctgttattaccactagaagctacattaattagacactgacatataataggatagactctaagtataaattatttctcatgcacatagcaccttgattggtagatattattgtcttctttcttccaggtaaaagtagagggtgagaggatgctcagcaggtggaggaaatataccaagccagggcacaggtttggttctgaatgaagggcatgttaccctacaacagtatgaacaagaaaacatgagtaacacaaaagcactagatgaacatatacacaagcgaacatcctcacacacaaacatctagtacaaataattaaactcagagtaattatcagtgtgattatgagaaagagataactcatgtcccacacagatgtaattaactatgtgcaaggcattgagtaaggtcttaggatattcctcaggtttggaatccccttcctgcattttcacttgttaaaataaaatcaccaaggaatatttacagtggaatatttgagagaaagtttgtatatagtttatttagtgttatttgtgttttaattctactttagtgttttgttgaagtatattaagatcacgtggcatatttctgtcataatgtcatttagtaagctctctccatacccgtttcttctacgttattaattttcttgtcgagacttgtattacttttttattgttgtttgttccacttaaaatagggccattttagtatctccaaaaacaatactatttctaattttcttacattttaccccaagaatctatccatatattactcaaaaaattgaaaaaaggcaaacttccaaacaacatgttaaggaaataaacacacttcagcatccagttttccctaaaggagaagcaattactcctgggatactaaatgagatttgtctgtggctcctctttgagaccagttttcctcaccagggatgacttattcatttgtacatcaaggaattctcagctttcttaccacttctagaagctggggacatttgatcatgtgtaggactccttacatttctgaaacacatctcagaaaagcaggtatagctaagccaacattttagaagtgcagaaaggcattttctggaggcacaccctccaatgctgcttttggagtccttgtgagattttgatttgaatcctccttctgtacctattagctatttgaacactgatgaggtactaaacctctatgaaccctaagtttttgtttattatattaaaaataatgctagcccttatatcctagaattgtgaggataattattagcaggtcatatgatagcaaatattgactgggttcttaacacacttcaggcattgtgcatgctatatgtttgaatccatctttgtatttaatgctaaccactctatgaaatagttgttatttatctccatttataactaggaaactgagattcaaattgctcatgtaatttggccaaagtctcacagttagttgtccagattcaaattccccatctattggactcatagtctctatacttccaggatggttttcacacctattcagtgctcaataattgtcagtcatcactgttgttattattgggagaactttgaaacacatttcccagaaactctcaattgacaaatgtggagccaagtctcttttcaagataggaaatttgtcttgtcttttctgtatatgtgctataacatattgcttgccttcttgtgaatccactaagagtcacatgttggcggtatgtatgacatgttcatgtctgtctcctttgtcaggtctctcatggtccagacatgagaaggtcatctttccttattcttcttcctcatttccacccactgcagcttgtacttgggctgtttgtatcttggtaagtgcaggagcgcttcagttcatcatcactgctgctttttcctctttccacatactggatcttgcattaatgactttaaatttggaaccattcattctactgtggctgttgggctttctctgtctttatagagtctcattgcaggaatacttactaagctcctgaaaactgacacacccttgcatttgacaactggctcattattattattattattattttattgtatcatttattgattttgaacttgatgctgggtttgattaagggaaaaaacttaaagggtttttcttttttaacttgcttatcttttgaccttatatctaatttcatctcatgacaaagaagagacatgaaatgtatttgaggtggtacactgatgattccatctgaatattgctttgtcattgttttgattagaaacaataaatggtgttgacaaactctgggaatgatttttataatgaaagagaatagtgaaagtggagaagtttcaataaatgatttttaaataaaatgcttttcttgaatataaaaaacatggtgttggcagatgacattgtaggaaatattactccaagatagactggtaagccttttaccctttccacttctctgtcacttcttgtctttctagaacatctcattactttcctttatgaattcttcccccaaggctctggtgttaggggcagccttcattttccatttcagttcaagggacttaccacttaatttaagtttcctcaagtctgaccctcaactccaaagttccactcatcatttcactttttagagcagagatcacctgcatgatagtgtacctattgatggtccctgatgtttcagaggcccctacttgtatattcagatgagaatatcaacagggccttcctcacataactgtaggaaaaggtcaaaacccagaccccatagagagacctgggacacttctaatttatgaatgcaatttttaaaaagatttaaaaattaaatgctatgacacaaaatacaatacaataggagtgagtgattcacaagatagtatgagtatatataaacataaatttatgtgggtgttgtagagttgaattcaagttcaaatttggggctttttgtaaatgtgagtcacagattaatttctgacatattgtacccctcattagggatacagcattatgataaatttctaagagaaaaataactaaatcacattgtggtcatgtttttagtgggaataaaacttaacctagaagagaaagcatgtaatgcttcattcaaatatgatattgatttgctgtgtggccatggataaacaacataacttcccaggacttttttcattttttttttattggggatagtattagttaccacattgaatgtaactggatatggtgtaaggacaaattaatttgtagatatgaaatatatttgaactataaaagacttttggacttaaaatggtaatgatgatacagccccctttcctcatgaaaattaatttaaaataactagaaggaaattcaacctttattgaaaagaatctttggccaaatactggaagaaaggctccagagcccagtatgccatttcagaagtagatggtatgcccttctgagaaaacaatctcttatttgcaacaatgcactctgtggcaagtgcatgcctggaagccactgaacgtgatgaagcaactggagggtcggaggctgagtcaggagacattgagacttaccacttgtatgaaaggagtcagacagtgaagcaagcttcaagggaaactccttcggaagcagtcctgagtgacatctctctctcgcctggggagaattaaaggctaaactagatataggaatacactttaatgcatttcatggtcagcctctgacaattactgttgtgctatatcccactctgaccctcctcccatagttccaagtactcactatattcaaaggtaaattaccagcatatagtctatgaagactcaccatgtgtaaaagggaccattgcagcataaataccaaggtattaaaataattagaatagaaagcagaatagaaagcagttgaaaaatattcaccagaaaaattttgtcatggagaaaatgaaattaattcccaaatgtattactaaattaagcaatagacattaacaaaacaataacttctttgaaataatgtctcaaagcagacatttgggaaacagaaattcaggaagaaatatagcaaggaaatagaaggaaatgactgttaagcagataaaacaagaaaattagtatattagtttgttctcatgctgctataaagaactacccaagactgggtaatttataaaggaaagaggtttaattgactcacagttctgcattgcttgggaggcctcaggaaacttacaatcatggcagaagaggaaacaaccatgtccttcttcacatggcagcaggagagagaagtgcagagcgaagcagggaaaagccccttataaaaccatcagatcttgtgagaactcactcagtagcacaagcacaacatgggggaaactgcccccatgatctaaccacctcccatgaggattacaattcaagttgagattttagttgaggacacaggcaaaccatattaagtataggaaagaatagtagaaaagaatgttacatccaaagttacattggaaataacctaaaggagaatagaaacggaaaatatcaaaaagcatgtgaacagtgaaaaaatgaaacaaaataaattaacagtgagttaaaacaattgtcaggatagatgaaaataatctgttagaaaatccaaacagaaaaaagaaaagttcagcatatgcataagtggtgtgcctgaaaaggagaaacgaatatatggagaaaaaaaatgtttaaagttactttttccagatgtgaagaagttttgagaataaacatttttgacttttaatcttttgtttggaagcccaacattatgaaaaaaattatgcaaaatgatcaccgtcaatatcctaatccacttaccttttaaaacacagtcatccgttggtatcttcaagagattagttccagggctcccagaagataccagaattcactgatgctcaggttctttggggtatgtattcagaaaccaccaatatagaaggccaactagaacagggaatcttttggggagtctgaaaggagatcaaatcctaaacaaagggtgacttcagaattcctctcagtaacattccacattaggaaaagaacaggtcaatgcctttccagtgttttcaggaaaaggcagtgtaacccatgttcctagactcagtgaatgtatcttttaaagtaaggcaactgacaaacagttttcaacatgaaatactgctcagaatctagttgccagattcctttaaaaatattctgacaatgaaaatgaatagaggaattacagcaaaagaactgttgataaacattaaatatgttgaaaatattaaatatttctatctgcattgataagtaaaaatatttctgagaattatgtttacagaacagaatgaaaatgttacaaagaataataacattgaaataatttatctgatacaatttaggatgaaaagtggaagagaaggtgagaggtggtatgcatatggtgaattcttcatcttttatagctgaaggcaaaaaaatgccactcaatggtgatttattaaataacatagcataaacatgcaaaggcataaaaatgtagtaaaagtgtgtaaacaattaaaattagataatgcagtaagagaagtgattggagactaagtggaggtataaattttgtcagtattacagtgaatggtcagtagataataaagaaatgtaggattataaatattatattggccaggcacagtggctcatgcctgtaatcccaggactttgggaggccgaggagggtggatcacctaaggtcaggagttcgagaccagcctggccaatatggtgaaaccccgtctctactaaaaatacaaaaattagccaggcatggtggcaggtgcccgtaatcccatctgttcgggaggctgaggcaggagaatcacttgaacctaggaaggttcaagtgaggttgcagtgagccatgattgtgccattgcactccaggctgggtgacaagagcgagactccgtctcaaaaaaataagaaataaaaaaatatcacattgtatttaaaaggtaacaaaaaaggtaatagaaaaacatgagaccttcagattattaatagtaacacaaacaggcacaaaaagaacaaagtgaaatattgaaaaaaaaaacctagtattatcatgaggcatactgaaacacaatataactaattctgaaaatatctaccatattaataaacgcattatttatcaaattttaataagaaagttatttccacaagaaatcaataggaatggatatctgtgcatcacataacatagactcacattccataatggaaaatctacagaaatttcagggcaaaagagaagaaaacatattagttgcaggagacataattcagtgtgtgaaaactgtcagtaaaaattagtaagcaaatagaagaccactaaaacatgattgatttcaaaatgttacatatcattgtgtttttctccattaaagatatgtcttcataaattctctaaaatttttagttaaacagttttctcttaaattggattaatagtttctgaattaagaacatttaaaaaatatctttaagaaactgctttcaactttatctttcaagtttttggctactcacacttagtcttcactgactcctacatgaactgaaactctaagcataggactaagagcaagtattataaatttgaaggcccatttgcaaattactatggtaggtctctcagttttgcaaagaatcagatgttcagttggctgggaggatatagaaaggaaaaatagagtcccttctctcaaaacccccaagtccagcagggaaaacacaccttatatatcataataaatagaatatgcaagataagctccagtgtatgcagggggaaagggactttggtggaagcagctaaaaggatcttgtaaaaatataaattaacgtcttatgatgcaagaatccagcctgttttaacatggattggatgacttgcttatcagagacttggaacaaaaaatagtggatatggatcacaagttttctgtgatctttggaggaagaatatgacaaaatcctgtatgttgtccttgggataccctcctgacatccccactccctctgtgttgcttgtgcttacagtagagatggctcttctcctaacaggtgctcctcaaattccagatctcattttgctgtcttctctcaggtacctcagacttctgaccgtttttctggttactaatacagactttcattgtttttctcttttgctgcatctataaatattatgatttgtcagaaattttgttttgtatacatttatgagacaatcggccagatggggctacaagaggagacacaggagagactcgagaaaataaagtattttctactcacaggtcctagagacaggaggcatgccatacatggcaacatggggaagaccagagtggtcaggaggcagaaacaggagcaaggtaagttgtaaggcatggcctttgttggggtttctgagagaagggtaaggcaggataggatgaacagtttaggactactttgaataatttctccagaatttgggaaacaggagtgttctctagttgcctggtacctggccctgggttgcttaagacagaagaatattgtttccagggtatgtgggcaaggtagaggaaatgtggctctgggttggttagtttgcgtgcttcaggctggtccctttcctatcttaagtattggcggctgttcgcagtggctcacgcctgtaatcccagcacttcgggaggccgaggcaggcggatcacgaggtcaggagatcaagaccatcctggctaacacggtgaaactccgtctctactaaaaatacaaaaaaattagccgggcatggtggtaggcacctgtagtcccagctaatggggaggctgaagcaggagaatggtgtgtacccgggaggcggagcttgcagtgacccaagatggcgccactgcactccagcctgggcgacagagcgagactccatctcaaaaacaaaacaaaacaaaacaaaaaaagaattggctagcctcaagcaaaggtgatctcttccccagttagaaagattttctaagatatcaaaacatcacaaggtacagaaaatttaaatatacatttatctacaatacagccttgttctgggccttcttttccctcactttctttctatcatgactttcaatccagtagcctaaaatgccatctatcttctaatgacttgcctgagattcactcttgtgtatctaactgcctctttgccccatgaattttcagatatgtccaaaacatacctcttggttctcctccccactcttgcttctccctcagtcttccctttcaagataaatggcaccatcagccaaccaggaggtcaaaccagaaaccattggcttctttaattccattactcttcccttcctatcccacaagcacctacttacacccacatttaagaaccttttaaccatctactcatccacaaaacttagttcttccttcaacagaaatctcaaattcagcaacttccctacacttctgctgccactgccactatcaccctgcaccaagcaagccgctttcatcttaccccttttctgtcacagtatccccccatcatattctccacatttatactcctagctgctctacaaaccatttttgattaatattggtaaaacaaacgacaatcactccccggctcaaaaccattctcattgatttctagctgtattcaggatgaaacatgcaaaccttaccagggtccaaatgccttcctagcataacctgttcacttctctggtttttccaacataatttttttcactcttctttctcccccaactcactacgctccaataccaatggtcttttatcagtttctggaacgtgttcctggtcttgatttaaaggaaatgtaattaaataaagatctccatagaaacactgtctctgtctactctgtctaaattattcccttcctatggtattttccatttcagcagtttgtctgtttccttcaaagcagctgatcacagttgcgattacatttacttgtgaccttattttgtgttttgtcatctggacgttatgttccaggagagtagggataatatgaatggttttctcaccatcagatctccagttcaatcacagagtaataacattataggcaatcaagggtagacacatgcaggacatacccaataaataattgttgaatgaatgatttaagttcaatttgttacaatattttattcaaaatagagcaatcattattaacaaaacatgaaagagaaaaatgagagagagctacagcagggacagcatcgtaaaagttaactgggatttgggcttctattagtggcttcagctcactaagatctttataccaagtcaagtcaggagaggctggagagagagctgagaaggctggctgacaaggctgtctacactccaccttacctgccatggttgtgaccatgctatgcagcgggtctccactgataactttcttccttcagccgtgcttgccttgttactgtgtaatcgggatgtgtttgtatttcttattttggcagaaacactcaagagaaggggcttcattttagtctcaacttacaactgctctctccaataatttttgtgtgtgacatatcctaattaggctcagtgtcttcctgcattcccagcaacttgagtgacagatcattctattaaatttggggagcaatgagactagggcaggggttggccagcaatggcctgaagtccagatccagcctgccagttgtttttgtaagcaacaaattttttggaacacagctgcaccctttcatgtacgtatcattcatgactgccttcctgcaaaaatattagtactgagttgatggatattgatggtggagttcacaaagctgaaaaataacttactatctgcccctttacaggaaaagtttgccaatgtctggactagagtatgaacttctttattctgagccttagatacagtattagaatagtttaactatttttctaacatctctatttatacattattaattaatttcagggaaaattggattttgtttacatcttccaatatcatttagttcagactctattatgttccaggcatttacttaatcgataaagaaagctttttgtgacctttccatctcaagtaatctcccactgctcttaaggcctatattgttttgccaccctagcactttatctctcatagagctctatctcacctggtgctttatctcccgtagcacacagcattttgaccttgtatgtgaatcatacgtgtgcatggctaatctagcctactagtgtggcattgtgtaaagaaaattgtattttgagaatgacagattgctaggctctgagctgcatactagttgggattctgcctcttttgctgacctggaaagttgtccagcgtgtgtcacttggtagacgttttatcatgcatgaatgagtccgcattatgcctctatattaatagagacttgcctccttgatttttgtagatcacagtagaactggatctacaatgaacattatttagcatggcccatccctgccacacacacacatagacacgcacacacacacagacacagacacacacacacatacatacacacacacacccctcactctcactggtgtcttgtgtccactgtttctaatcattaaatagaggataggtttggacactgtacttttacagtcagtcgttagaatcctaactctgtcatttattgagggactttgaacaagatacaaaagatgacctttaatttcctcatcttttaaatgtagctaatcacagccaccttccagtactgtagtaggaagtaaatgagatagcaagcacaactggaaggagctggcatagctcataactcactgtaagtggtcagtagaggtcagttttgttcacaaccaaggcctgcgacttccactccaaaatgctgagggaaaccctgcttctcagttacctgaattgtagtctccaggggtgtgaaagccagggtgcttcttttaatttcctgctccccgtgatttcagatcccctcattcagtctttgccatccttgtacattgcactacaatctgccacagtgtggaagccagaactctgagtcattactgctgttccctgcatccttaaggcctcggaaatatatctttactcagtccacttctcacttagtttctcagtcatctgtttaacccaaactatgattttattttccctggtctgattgaaaaatcttcatcctggcctccctctatctccttctccatatgaaaactagaactttttttttttttttttttttttgagacagagtctcgctctgttgcccaggctggagtgcagtggtgcgatctccgcctactgcaagctccgcctcccgggttcatgccattctcttgcctcagcctcctgagtagctgggactacagacgcccaccacaacgcccagctagctttttgtatttttagtagagacggggtttcaccgtgttagccaggatggtctcgatctcctgaccttgtggtccgcccaccttggcctcccaaagtactgggattacaggtgtgagccagcgcacccggcctaaaaaaactagaactcttaaacacatatatcagacaatgtcttttcaaaaactcctaatgatttctaatgaagattaacataatatcagatccctatgcagtggtctacaggctgtcatggagatgcctctaaattaattgcatatcttggagtttgttcacagtataccaggctccaggtcccatgaactgatgtcagtagcttttaagaccaaattattttctgcctcagcacttttgaacattttatgcctcctccttgtaaatctttctgcctctgtttgcaaaggtcattctttatatccatcaggtgtcagttaaaattatactgttggagatctctatgaatactccattctttttgtcattccttttcttagaatcctgtttttcctgcttattcttacaacaatttgtaattttataggtagatagctagcaatcatttacttatttttgtttgacattcctattactttgtgtactctgtgaaggctgaactatgtctacttcattcattcattcattcattcatatatgctcagacccagtgcattttttttttgctatatagtagtgcttaatatattattcttgaatgaatcaatcatttgatcaatcaacaatgattttaggcaaatttacctctccccagcatattttcctctgagcataaatggctcactgaaattctggcctgtaaatagaaatgtatatttcctaagaagactgcgagtataccaatgatttgaaaaatgaacagaggttcttacatgactttaagaagataattccctttcaaaatgatgctttttccaaatctagtaacaggacaaagtaagatcattttgttgcttcactctttaacattttaattgtcaaagagcttggagaattctctttgaggtttagtgcacagcaaagtgtaataagaaaaagtattggtttcaggttacaattggtaaaagaaatattttaagatgtctttcagcaatcttagtgtttctctgtaatcataaatttgaaggtactgattttactatattggtagtaatcttaaagttaatactctagctgcatatctcagaatgatatacaaaacaaggatttccattttatttggaattataaaatgcttttacaaagcctgaatttgtccatagctcatgaatattccttttgtagtgttgttttgctattttagaattcagcaaaagaaacttgaattcagactacattctaagcatcaataagtatagcaatcctataacacaggcaaatataaatgcctgttctaaaaaagcttaaaaagaaaaaaaaaagtccttactgagtatataaaatattacgtttttactcatttaatcatcatccatgaggtgacaactattatctcaattttgccagtggggaaagagtcatacagaaaagtcccttgttcaaagtcacattggtagtaagtgactgtaaggatttgattgcaagtttcttaaacatcaaagttcaggttcttttcattgctgattgccttctgactttttgcatcatccagttctttttctttctctccccctacccttttccccattctccattccctttcccctaccaccttgagacaaccattctaatttacataatgtgtacatctggatttgtgtgtgttcttacatgcattttttatttacttgatgctagtttccacttttttgattaaacattctatttttcagctcacgttgttgtgtgagcatataatctatcacttctcattgctgcatgattctgtccattaatggaaaacctgttttcttctaaccttctaccatcataaattactctgcagctaaaaggcctatgtcacttatttttagtgcattatttttaggttataccgtatatatatatatataatatttatataatatatacttcttgtgcctaaagttctttacttcctccaagtcataaagatattttctcatggttttttcttatatctataggtttacatcttagatttagatttttattccacctttgtatctgctgttagcttagttccagttttattttgatatatagtatgagccagtatttataatacgatctattaaacaattaaatagtttaaatatttttgtattgtattcacaaaaaggaacttatttttaacttctatgtgtgtatatatatgcatatatacatgtatacacatatatacacatacatatatattttttgagatgggagtcttgccctgttacccaggcgggaccataggcatgtgtcaccatgcctggaaaatttttgtatttttagtagagatggggttccgccatgttggccaggctggtctcgaattcctgacctcagatgatccggccgccttggtctcccaaagtgctgggattacaggcatgagccaccgcacctggccaggttgcaccatagtatctaaagatttttctgtgtctttacaaccattttttttgccaatttaattggtgtaaatgatatttattgttgttttaatttatctgattactaattaagcatctctttgtttacctattagcattattagtttggcagtcttaaatatcacaaatatccttcttcattctgtaatctatgactttttttgcttattttttgctgcctttgctttaaaagttcttcacttcctccaagtcataaagatattttctcatggttttttcttatatctataggtttacatcttaagatttagatttttattccacctttgtatctgctgttagcttagttccagttttattttgataatatagtgtgagccagtatttataatatgatctattaaacaatgaaatagtttaaatatttttgtattgtattcacaaaaagaaacttatttttaacttctagagaaagaaaagtgactcttaatattataacgcctttcccataatagagtgtactggtattttttttaaaataagtgcaagtcatattttatgcctgttttgaatctgatcaaaaaaagtttttcctatttgtgtgagtctgtaaaggcacatttccttttgttttttctgctttagcctagagttctcgttggaactgacatgacataggattttacattgaatagttaaagaaaaaataactctttttccccccagcaattaatataccactatcgatataatgtgattttatcagtttaaatggaaaactgaaattaaagagaaattctctattaaagataatttattaaaattggtaaattatatgcatttgaataaaaaaaatcattaacagacttttatttcttttccaaatatgaagatgaaagtgtagatttcagatacatataaaatgcatgttttattatagcattatatgattttaatagaattattttccactaaatgatggttgcttaagaattttggaagaatggaatttttgaagtatgagctagaactgaagggaagatgaagagtccgaaatggttcctaattccattaggggaaaaagacttttcaatcagtcactcgagtgtccacagagaaacgtctgatgctatttcaggggataatctagtggaggaagatggcctcaattgaaatgcttagttgattatgtagttcattccagaataaataggctatttactttgtctgaaagttcaatagatttggatttcagtcaaatggaatggcattagatctttctttatgaatgttgatacaagtgtgtttagagaggacttctgtcagtttttattagtaatattcttattggttgagttttcttctccctcatttgctcagtgctccaattttgtggaggtcattttatttttgacgttatgacataggcaagtagaagcctctaagattttttttaaaaaaccctgttacaatgttttattcttataattttgtaactttcttaatcaaatgctgtggagacaaactgcaagaggaaaggttctttttaagggtacacacatgttggagatgaaattccttgagtttttgggagaaaataagaaacctgctgattctctgagctagaataatttatacttttctatgaacattagagaagtgatatactttaaggtgtgaggacaaaaacttgcaaaaaaacaacattgcatttgaattatagatggcatctaaatgataaaatgtataaaaatatccctaaaagataatttctttgtcataattgagaggggagcagtagcgtataggagagtttgccacacagaagatcaaatttcagctctgacatttcctactttgagaatctagctgaattacaattctaaacttttgtccttatcagtaaaatgtctatatctgacagtatacaaggggtatcttttgtgcctagcttaactgggccctcagctgtttatttttttaatttttccttctgtcctccatcaccattcccagattcttacattaaggacaactaagctaaacattactcataaggaagacaccttgtttgttttattaatagctagtttagcacataatacattttaaattgtctgcctatgactaatggcaaaaggtgtaagtccgtatttctttagagaagtaaaataattggcctttatttacagtgatcttgtaatctttgttcttttgtggtggttactaattatgtcagtgtcaaactaatcatattaagtaatggaggttaaattcccccagtgatttagaatacaagaatggaatattttggcattaaagaatgacttttcttttggaagtacatcgcgaagtctttgcaatatacatatttgtcaattaccatctgtgtaaagcaacagacagctgctcagtagcatttcctggagtggactggaaggatctttctcaccatatgactctgagacagttagagacccaccaaattgaagattacttgatgtaaattcacagcacatacctggttgatacagtttatattaacatgtttcttctaagaaacaataagctcttttttttcaataaggaaaatatttttatctgggaaaaactgtacaacatttatatagtgaatgatattcttttaaaataatttgttataagcctttcctaacagtgggatatgacaaactagaacatgtgcaatacaagtgatattttaagaagacactcagaaatgtaatccaacttcaatcgtggatgccccccagttttgtttgttttctatgtctggaattttcttgtcataaaattctaaattatttaaggtgaatatcctttgcaaaagatggtgtctaaattatgtctccagaaaagttagaaacctgcagtttcaggaatattttcattgagtacccatcaagtgccagaaaatatattagggacaaagaacatttctgtaaatagaacaggcaatgatatttgcccatctgttgggcttgtattttctctttgagtaaccactatgtgctaagtgaaatgtagtcaatttaaaatggtttataaaataataagaaaaaagtcatttataggtacaacattctttctaaggagtgcagaagctgaagttattgttttgctgagacctggagaggtttgcatattcaaaattgggggaagagctaattacttgtattgtagaagaagactttggaattcttgtggaggagattaggtggagagagagggtgggggtgtgagagagagtaagaaagaaaaagtgaagtacatgtgtttcccaaatgttgtgtttctgtacatctcaggcagggaacccattctccacccatctgaccacttctgccttatttacaaattttgatttgctggaaagggaattctactggcaaatgcacagtctgtttctcactgatacaccttggctgagtttctacctacagtctgacccttttgaacagaaagtgttaaggacttcccgttagggctcgtgcttaagcctcaggttgaacctacttgatccttaagaaaagcaaacaaagcaaaactctcaaacagaaagcactgtgtacttatttccttccataaaattttattgtgcactgtgttgcagggactttgctgagcttcacaaatttccttcatacaacttttactgcatgtaaaagagacccactccaaagttaaagtgatatgttgtcagaacatgaaatcaaaccagaagtaaaaatactggatatgtaaaaaatataacagccttctagtaaatatgcaaaaatcaaaatatgcaaaaaatcagtcttctagtaaatgcaaacatattggaaacatgatcattactgataactagaaatatttctaatagcagaaaataaacagaaaatggagaagacataatcaaagaaataataaaagaaaatatgacttaaatttacaatacaagtgccccaccacaatttaaaattttaaaaagacaagctgaaggcacatatttatgaaaattcataatactagagttaaagaaaaaaatttaaggtctttagaaataaaaattaagtcaaatcccggtgattagtactcaaaatgactttacactttccaacagtgatcctagaaattagaagaaattgcagcaatgtattcatattctgaaggaaaataactatctttcggtctgaattgtcatgattatataaaggttaagtaaataagttactccaactttcccaagttaattttttaaagaaacatagatcttgacttccagctaatacacaaagtttttaacctggaggaaactgctaactgagctgtgatggtaagtaaaatgtgtatttcttttcttttgggtacaatagctatatcattatacagcaaaggagagaaattgctacgcaggatttagtgatattttcaaggatagcatttaataggagaaatttctgcttgaggtgaagatctgtctggaaatttttgttagactaatttttttaaatgttaattatgatgctatactttttctgaatcagttcaaggagattaatagtcaaaaaagaaggtgtgcagacagttgcttaatgagatctgagaaggaaatttagaatcctatgttcttttcatcatcaacaggcattttacctaaaagtctagaaagacaccattgtgattttttttcctttgtcctgtaactctttcctatggcttggacagtgacaatagcattcgtgctgttcaactggcagggaacctaattatggctgttttatctgaagctcagataatttcagagctctttgaaaagattattaccttaatctaccagttaaattcttcagtgcacttatgagaaccatagcatcaactctgtagattgtaagagaaatctagaatttagaaagatgagggagtgagcaaaatgagcattgaattagatgtctggagacctaggttctggaactatttttgggtagttgacctcatctttttggagtgccattgcctaatcagaaaaataaggacgatggaataggtggtcttctgaatctaaattattttgttgaatttttttctctactttgaattctcaaaaatattttgctttagaagcgttctattagtatgtataatgatgtaaagcagcggtccacaaccattttggcaccagggatcatttttgtgggtaacaattttttcacaggccagggggtactgagagcgggggatggtttcgggataactcaagtgcattacaattattgattgactgattgattggagacagagtcttgctctgtcacccaggctggtgtgcagtggcttgatctcggctcactgcaactgccgcctcctgggttcaagcaattctcctgcttcagccacctgagtagctgggactacagatgcccaccaccatgcccggctaattttttgtatttttgtagagacggggtttcaccttgttgcccaggctggtctcaaactcctgagctcaatctgccctcctcagcctcccaaagtgccaggattacaggtgtgagccaccgcacccagccagtgcattacatttattgtgcactttatttatattatcattacattgtaacatacaatgaaataattatacaactcaacataatgtagaatcagtgggagccctgagcttgtgttcctgcaactagagggttccatctgtgggggatgggaggcagtgacagattatgaggcattagattcccatagggagagcataacctagatccctcgcatgtgtagttcacaatagggttctcactcctgtgagaatctcatgctgtggctcatctgacaggagacggagctcaggtggtaatgcaagcaatgggcagtggctgtaaatacagatgaagctttgctcactcaccagcagctcacctcctgctgtgcagcctgattcctaacaggccaaagaccaatacaggtccatggcccaagggttagggacccctgatgtaaaagacttatatatgttggtgaaaagagcagacacagaggaaattccacacacacatggatttaaatcttggatttattcttaggggcagtatcatctggaatggattattctgcctctctgagattcaccttctacaactataaaaagagaaacatggcacttagttttcaatatttttcaaaaattgctaatagtataagtacctgacataataaaaacattcaattaatagcaactgttatttgtgtgatgttttctaacttaagaactaggacatgaatttaaccacacaggaattctcatttttgagaagataaagaatgaggaaaatctgaaaaatattggaaatcattaataaaattctcctttgatcaaagatttatttcggcattccctaatttgccctgctcttgggtacgttagaatacatttatcctactttacactttgaaaaatttgtgcaaatgccatgattgtagcattagcctgattttttcccagtcttctggtttttttttttttttttttttttaactcaacatatattgtgaaacactcgggtatttattcctcaggaaagtatgacatatgaatgagagctagaggataagatcttgtgataataaatttttgaggttagtctctctgtgtccttgcagttttcgcatgtaactacttactctgtggagtctacacttatatgtaaaaggcagtttctgtgttagctggtttattttaaaaagaaaagacttggggcagtgaccatctcccttatctgaagacagtgatattagatcattcccagactggcctattttgctttcacatactgcaaaatgcttgatatgcctcatttttgtgctttagtaatcattcagactttgacatgcatttcttgagggtgttataacatgtttttgaattttctccaggaagcactctgatgatgtgatgaataatttagctggataactatttactagagaaaacacgaaggatgaaaaaatctaaacaaacttttttcactgagataaataatgagggcacctactcttttggcaaacggtataattactgctttcctggttaccagtgaaatctgggatatgctaatgctttggcataaacaactgaatataaatctcaataattgaagtttgaccaaaagaggggttaaatatgtctaagaggtcaaacacagagcagaaaaaaaagaatgggaaatgatcttagtctgaatcgcaagattgcatgttttgcttttactcaaaagagaaggaactggtatttagaaggagtttttttttcagagagtaaggcgttcagagtcactgggtctgagtgtgaatgctggcccacctgctatgtgaatggccttgagcaaggaaatacatctctcagcctggttttccacttctctaatataggatcacaccctctgccttggctacataagagaactgttataaggtatgctaaagttgcaactgagaaaacctgccgtaagctataaaggactaggaaatgtcagaaatgattgtaatgctgttggcccttcagctgcagtgccagctgcagaaattaaaaggaggctgaaaatttgatgttgcccttggaagtgaggggaaacattgttctcctcagcaaacctggtctaacatgtctgccaatccagtgaacgtatttcagcatgtgtcatgtgggatgcaccttatgaagggctgtctatacagatgttagggtatatcttagttaatttggcttataacaaagtgccatagagtgggtagctcataacaaataaatttatttttcacagttctggaagctgggaaatttgagaccaaggacccagcatgttcaggttcctgtgtgggctctcttctgggctgcagacggccaccttctcgcatgtcccctcttagaaagagaataagagagctcttgggggttccttttataaaggctctaattctgtttatatgaactattactgatgacgtaattacctcccagaagccccaccttcttatgccatccttttgggggttggaatttcaacatatgggtttggagagacacaaaccttcagtccattacagggtccaagttgcttcatgatccacaaactaccaaaatctaatacttgatacaaattcacccagaaaaacattagaatacagggatctgtcttgttctaaaatgggaatttattatgcttaaaccaaaccttatagtgaatccttgaaaattcagaccagagtctgaatgtacccctctagggtacttaccacttggatatttctagtaatttataatgagcattgagactgcccattcagatatattcatatacttctttaaataatcaaaacgtgttttctcttcccttctatttactgctgattttcattctacctaacttctctgcaaagatggtttaccttggtaactagcaataacaataataataatagtaatagtagtaatagcaaaggtatcatttacttaactccatcagaattttacatactcttatttctgattttattatttctttaccatgcaaatttgaacagaatcatctctgtccaatggcccatctttcttattactcatccactcttaactgcttgcaatgtataaccgtaaccctgctctaaaactactgacctaacaggcagcagggaattccttttattcagttcactagctctttcaaaattctaatctgctttgacttttcagtaccatttaactctctggaataatttctttgtttttgaaatcctctatactgtggcatgtcaatttatacctttgtgagagcttcttggtctcctctgtctactccctctgttcccagtccctgtgtgtaaattctgccctctccattcccactgtgactcctcagttttaggctgtcatcatttctcaccaagatgttgaactggctcctccgtgagagagcagagtggagaggtgaagcaagtgtctgcctgccttcctggtccatgacctctccctgcccttccatgctgggtgaccatctgcatgtaaagttggttttagctttcttattggtgaagtggggataataatagtatctattttttggatgaatgggaggggtcaatatgttactacgtgcaaaaatgcttaaaataattcctggcccttggtaagtgcaacataagtgctgccattactgtctttgttttaatattagttatgatcattatcattttaagtggtctccctgctgttggatcacttgcttccagtacattctgtacacagcagtcaaattattgtaaaacaaagcttagtttatgttactaagctgtttcatattcatatttgcattctatattgcctaacaattttaatcaggccctcaatagtcctggtttgtgtttcctggcttgtctgcaagtctcagtataatagtcagtactgatgtctcccttccccaccgtgctttccttactttctagaattgtgctttccttccacctccattaaaatcctacctgccattcacaagacccagaacaaatgctaccagacccttgatgccttttgtaatcctctatgatcaagcataagtctgtcctctctgaaactattaagtaaaggtctttattttaggtttctttttggccccatatctctgtatttggtattttatttatttatgtacatgttgttatcttttttcctagattataaactccttggggaagagcctttatatggccttccagctccctgcacaggacattacatccagtagacagatgttcaatgaagggctattgaattcatgtggatttccatgtgagaatagagctggatattcacttccctttttgctgtgcttgctaagcagactcatttgcaccggccactaccccagttggtcaccaggaatagagggtacttatggagattcttttcccaccccccaccatcttttaggatttagatgttgtttatacactgaaaagttcagcttttggctcatagtagcagatactgttggatatttgttgaatgaaaaagaaaataaatagtaaacatttgctgagtgagaaagaaaaaataaataatgaataaccacaccctgacccacttgtctgccagaagtgggaaaaagttgtaaataagcattttctggaggaaaaacacacaacccacacttgcttctgaatggtgtgggaaacatagattgagtctaaaattgagaggcatgcttatgtttactaagcacatggagaagcattatcagaacactactggcttttgcaatacattctttcgtcttttcaaaagtaactttttctatcacatttggcttaggttaagattcaaatcaatttacccttcacttgattcgtttttgtcagtgtggtaaccttatcagcaatgcagtttgcacccaaaaagatttgctgcagaaatgaatgaggccctctaagcccaatgtgaatataaactccacagcgatggtagaaatggtctcaggtgacccgtcagaataagaagtacttcctctccagaggtcctggcttgttatcccccagagccacacagtgaatgaagctaaactcctgttcttgaggtggaattatctcataacatttgacactttagtagtttataaagataacccaggaaataaaatttcaggagttgaaacaagtattcactgaagacaggacaactaaaatatgccacaaaaattgaggatcaatatatcaatatggaaggtttttaaaaatttttatttgtttaacttttatttttgtgcttggcttttcttgggatgtatttaggtatgaagacagtagaaataagatgtatacactttgggaggctgaggcaggtggatcgcctgaggtcaggagttggagaccagcctggccaacatagtgaaaccccatctctactaaaaatacaaaaaattatctgggcatggtggcaggcacctgtaattccagctacttgggaggctgaggcaggagaatcacttgaacacctgggaggcggagattgcaattagccaagatggagccattgcactccagcttgggcaacaagagcgaaactccgtctcaaaaaacagaatgacttctgctgagatatcaagaccacgttggtcttgacccctgcttccaggaagccttgcttgactgtctagggctgaattttataccattttaaaagaccctgctaattcctgtccttacatacatcacatagcagtgatcatttaattgtccagactccccatctacgtcacaagccacctgaaggcagatcacaactacatagctccttgcctggtgcctggctctagtctatatttaccggatgctgtattaaaagaggtaaaaccaaggcatgagtctgctgttgcagctcagaggcctcaatcagacagatgccaagctgcatttgatcggcagtcttgtatatttgactgacaacgttctggcttgcaagtatttaataacaacagaaagtgaattagtcaccaatacataaaaattgagagactttacacaaatctgaattcctgggctctcttgaaatacctgaaaatctgacgacgttggacgtacattgctacaaaaacctggagaagaatgtcatggctatgaatagtgaaagtattctccactctatcctattccccctggcacttaaagcttccttagttctcacctctaacaacccactgggcctataggaacttggagctgttccttctcttcctgggtgtctcattagagggatgaccccaagcttctcctccccctcttccctctgactcttcctcttgttaaaagagcatggatcttgcttcctaagaaggatcttatcctctaaagccattgtcctgctgagcgacaggaagctcctcatctacagtggccctgcaggtaccgagaaggcttttcatgcagctctgactccacatgggagtgatcacaatcaggattccctcacagactgcctggcttcagtgctgcactctcctgccttgagtcttgaactgcttcgtgatcctgaccacagtcttgtcacctgcttggcctgagaagcatgaaggtggtagatcctggtgccgctcctgaccacccagcagataacactttgattttttttctaagtagaaattgatcagtgtgggatttcgagattttcaaaggtgcctttgtttaaatcgagaattgggcaaggtagggatcttcgttaaaaagcaccatgtggtcaccggggttaatgaggcagatcagagcagcactgacactaaataaaggccaattaactccaatcactgcaggcctgggtgctttctggcagtgcaatctccctgtggggggcttcttgtcctgacaactctctggcagaggtaaggaggactggctccaaaagaaggcccctgagcaatggtgtggggtgagggcattgcccctccccaccacactgcccatcaggggcttatggcttttcttggaaggcatcgcccccacccagcctgccctgcatggtgctgtggacagagaagcaagactcagagactgaggccttctgtgggctcccaaccagctcaggggccaagcacagagattcagattctcaagaccccttttctctatccatttaattaattgccttgaagagaggatcacagagttcttgctgaaaaattatttaagtccatgaatgaagacaaatgatttcaacacaaacattgctcaattgggtacaaaaaatttttttcccttgtgtttgctttagtgataaaaatagccagtgctgatgatataaatttcacctcgtgccaagtgctgatctgaaacctttacctacattggctcagctggtcttcacaaattttctatgatatggatactattattaatcccatttatacatgggaaaacagaggcattggaaaagttcagttctatgctaggtactttccatgcctacttctatgtgattctcataaaaacctctgtgtggtgagtatttttagcactatattacaaatgaggacactgagattcagaaaacttgtgtgacatatctggtacagtattgctcctaatgatactaataaaatgaggatttggattcactttttttttctatttccaaagtatggtggtatagaatagctaactgcctaggctgaaggatttaaaatttttccttaagatttatctgtgagccctcagtttttctattcaaggtttctggattggagagtataatcagtaccaaaaactaataatgatcttaaaatagtgggtacagaataatgcctctggctccagcttgctccattgagtttcacacctggctgtattactttcttgcttctgacttctttcagccactaagccgtggatgttctcagtcctcagtcattaaagactagaacatcgcccaaagccaccttcgctactgcaactacagtcattagcataacagacctcagcatccacagaatcacttcatccaacaccccgatctctcattccctttgcctcctcatctccaaccaccttcttcgcttcgtctaagccacacatttcatcatcataccttggaatttcccaataccaacaactatatcagctctaatattccatgttaaaatgctccatttgtttatcaaacaccctctgttactatctggttagttcaaatacctcccatattctctgacctcacgaaactcccaatttcccccaacacttagctccctgggagcaccacttttctttcactcctgcttggatgccatgattccagcattagttgctctcttcctacttcaaacccacaagatgaaccttcctatcaaccttctccacattgacaaccaagaagttgtagacaatcacacaatgggggagcttggctgtattgtttatgacatacattcaggtcatctctaactgagctgtcagtcctgctcaacagtctcactaatttttctttcgagctcactctcccaccttttatgctaccttataaatagctcttctccaatccttccgtttcttttcattctcacttcaaacacaccagactcagccaccatcaccttactcaaaagcacaaatatttttctaatcagtcttcaattcagtcttgccactttgcctattcattcaccacacataagtcaaaataatgtgtttagatcctacattttatcatttgattcccctgctttaaaactttagtgtcattccatagctaataagataaaataaaaattcttacctcggttatcctacaagtattggttcatctggctgtgcctaaacctcaccattcttgcatacaataatccacccctttacattctaccttcatgatcttattttagtttcttgaacatgccaagcttctttccaattcaatgtattttgcatttgttacttatatacttgtctgtctctgaaaaacagctcccgttcattacccagctttcactatttcaagatctcaacttaaatatcacattcacagtttttcacgaagccccctctacccctgtctgttgtgagtcactgctcctgtcattcactcttccagtgctgggtgcttttcctttaaaggaccaaccatttttagaatatttacatatgtacttatatttttaaattctatcttggaaatcagattgtaagattaagaatggaaggttccagatatgctcacttactattataagccaggatctagtacagtgaaacttgagaaacatcttataaacatttaattcactttaacgtaaactagatttgataccttggacttggtgttaacctcccagaacctaatttcctgagtggcacaacaggggcacaatactcctgagaactatgatcaggttgcagtgtaataatgggtggaatccacactttggcaattctacagtgctttgccaactacaaagctgatgacctcagtgacagtgagcacacccagtgcccagagcttggtttgtaataccattcatcaattaaaacaacttggtttccttggagagatggatgattctagggttaaagcaagaaatatatatttacctatatgaacctggagcatcttatactgccagaaagcaaggaagtgctaaaaacaaaacaaatacacacacacacacacacacaaaacaaaaacaaaaaactcacactgattgttagatatcaaagggacacaggagccaacaaaagtatttcaaatggccaaagctgaaaaaatttgagcaacaaaataaataaagtagttttgtattataactgaaagtataagacaaatgttgatgagaccatgcagatataaataaataattgaataaatacaaaaatgagaaaaagagaccaatatgccatgcagaagaatttacgataatttatgtagatattcagtccttgaggtgttggctgtacatagtgaccttgtttctccttcctgaagagtacacagggaaagaaggaacaaggaataactaaatggtaggaaaatctgacaaacactaccccagcccggtaatcaaggtcaatactcacaatcataagtgatgctgatattatgtacctttgataggacatgatgaaaatggcactttacatctgtagtcttccttcctggaacccataaacccaatctaattgtgagaaaaacaccagacaaattcgaatcatgggccatcctataaaatacctgaaccagaactctttaaaaccatcaaggtcatcacagacaagcaaaatctgagaaattgacacagccaaggggaggctaaggaaacatgacaatggaataaaatgtggtctgctggaggggatcctggaacagaaaaggacatggggtaaaaatgaaggaagtctgaatagactgtggactttagttgataacttcctatcaatattctttcattcacagtgggaaatacaccatattaacgtaggaggtaatgcaattttatcttactttatggtggaaataatagaggaaactgggtgtggagtatgaggaaaacttctgtactgttttctcaatttttctgtaaatcttttttttttaaaaaacaaaaaacaaacaaacaaacaaaaaacacagagtcttgctctgtcgtccaggctggagtgcagtgtcatgatctcagctcactgcaacctctgcctcctgggttcaagcaattctcctgcctcagcctcccaagtagctgggattacaggcatgcatcaaccacacctggctaatttttgtatttttagtagagatggggttttaccatgtcatccagggtggtctcaaactcctgacctcaggtgatctgcctgcctcagcctcccaaactgctgggatcacatgcgtgagccaccacacctggtcaatttttcaataaatctgaaacttttcctttttttcttgagatggagtctcgctctgtcacccaggctggagttcagtggtgcaatctcgtctcactgcaacctccatctcctgggttcaagtgattcttctgcctcagcctcccaagtagctgggactataggcacacgccactgtgcctggctaatttttgtatttctagtagagatggggtttcaccatattggccaggctggtctcgaactcctgacctcgtgatccacctgcctcggcctcctaaagtgctgggattacaggcgtgagccactgtgcctggcttaaatctgaaacttttctaaacatgaaatctactttaaaaatactgtgcatcatcatcatcatccacttgctgtggtctaaaaatactcagatgtatctaccttctttcccccaaatcgatgcctttgttgttgctttcaatgtacgttattttgaatgctttgtatactgtagagtgctccacaaagtcaggaagctctttttcttgtatggctcactgccctcttcaggtgtcacgctggatgttctcaagttatctctggtcttgtcaggctttactcctccttcctgtcctgaggcacaggcttgcactccctctttctctacctctgtgtttgctcacactcttgctctctatcctgctgctctaccttctctttctgttcttgtgggataactatgggaataaaattcagatttattttcctaattctcttctgaaaattttgaactggggaatattgatgtcttctatttctatcttctaactttacaaaataaggatattctccagattcacaaggaatgtgtatgagcactaagagaatgcatttggaaccctttaggcaatggaagaggaaggaccagaaattcagcaaaatcaatagctgagttcttacagagaaagagaggcagggaacattatgtctctatctatgatgagaggcatgtttttctactctctaggaaatgacttcctgcaaatgatggccagataaatcagaggtcatggtccgtggaattgctatttttctcagttgacaatgtgtagacgacagggtttataaccagtactacttctcatgccatttgctctgattttataacagcgacttcagctccaattgtggacctgattgcaagatagtcttaaattctcaaaaggagctagaaccctggaatgtatgtaaattttttaaatttatttttaaaacctgaatgccaaaaagtatttgaatgaaagagtcaatcagtccaaaaacaattgcgtacctctctggaaggtctagtgaaagggaaagagaagagagaaggaagaaaggagaatggggaaaaaaaacttttcttccttttacatatccagctgtaatgagttcagaatgcaatattgtgccagtgggttacagtgtgtttcataaaaggccttcaattcatgttagttgagtgaataaataaagagatacattgaaaacaattttaaggtcttttgtaggagtgattagcaaacatttataaatacaaaaaaaaaagttattaagaattctaggccgagcgtggtggctcatgcctgtaatcccagcactttgggaggctgaggcaggtgaatcacctgaggtcaggagttccagaccagcctggccaacatggtgaaaccccatctgtagagatatacgaaaattagccatgtggtggtgggcgcctgtaatcccagctactcaggagcatgaggtggtaggattgcttgaacctgggagacgaaggttgcagtgagccaagatcacaccattgccctttagcctatgtgacagagcaagattttgtctcaaaaaaagaaaaaaaaattctgatttttcctatgatgtctatctaacaaaataaaatcaccatattttcttgcactttgccctgaaaagcatagtattaatatggaatgaattggagttaggtaaatctaagtttaaattctacccctattacctgctaactacagggccttacatgagtggataactctctcctccttggtgtctgcatcttgcataagtctctggctaaactcatcaattaccagatactccccatttatttcccagatagtgcctaacacacatcctttaacagagagcaaggttttgtagtcatctctctttgtaaccgctttgttatttaatagttgtccagatgcagcagtgctgtaggtgctgtacgagaataaaatgcatcagttaaaaattattccaacctagtttattgacattctcaattatattggtcatgaatggaacgttcctagggaatagatggtgataatagttgtgctcaattatggccttatcatttttaggtgtcctctgttttctatgactcataattaggactcaacatttttatatttgatcattttatttttcttattagagtccattattctcctgtgaagttttgccagagatatggcatacaaattggatttgtgtatgctgtatactaagtagacatttgaggaatgaaaaatatgaattcacaaattaggcaggcatccttgttgtatctatcatatggattttcatgacacagactaaataacaatcattgcacaaaggccgtagtgcagcagggcaaatggtggagttacttgtttgatattaattcagtgctttgcccaataatgcaaaattgtcctaatgttacatttgaggaaaaagacacatcgagtgccagcattcaaacaggcagtgtgttaaggatatgtttataggttgccttatcaaacagttacaacaaaccaagagaggagttgtctgtccttcaaagtttagatgaggaatgtgaaggttggaggtgtgaaatgccagtcttatggccacatagctcccttgtgatagatccaggatttaatgctgggtatatttcacatcaaccataacataggtcttccactttgagaaagatacgtatttaattttacttggaactcgggaaattagaaacaaaagcagctgtggattgaaagataggaattgtgcagattgggcctgaaactgatatccccaggaaactaattgtgaaatggaagatgaaagttgggtgctgggtgtgacagtctctgggattattccagagctcagacctattctgtggccttatggaattaatgcaaccccatatgaaagggagcttttcagtcaccatgggttaatttcagacaaataaaacatctgccattgatcgaaaatctgaatgttcaattttacagaagttgttatctttttcacttcagttcactttccatttaaaactgaaaatcaatccttctcagggcctttgtgtgtttttggagatgcacactacaatttcctgccaaaatacttgtcaaatgttagcatacatttgacaagtagtccttgggccagagtcattaagataaaaaatcctggtttactcaatctaggaagacccagcgcacctgacaccaagtctgtgcagagtaaccttgaattcaggatgtttatgaaaattccagcacctacactcctctttattaattataaattagatggcacaccgtagtaatcatcttgttaaacacagccataggcaaacttagaaaaagaaatattaagtaaaaagtagtataataaaatggcagcagaacaactaggatggagtttgcaaacactgaccactccgtaacaatgaattaggctgggtgtggtggctcatgcctgtaatcccagagctttgaaaggcagaggtggaaggattgcatcagccccggagtttgagaccagcctgagctacatagtgagaccttatgtctacaagaattgtttaaaaatattatccaggcatggtgctgcacacctatagtcccaactactcaggaggctgagcggggaggatcacttgaggacaggagtttgaagttaccatgagatataattacacctttgcactccaacctgggtgacagggcaagaccttgtctctattaaaaaaacaaaacaaaactgataaacaaataaataaatagataaaaataaataaatgttattcaggctgcagccaagtatttcctgttgctacaatgccatactttctattccctgtcccacaaaatacgcattcatttctaaggctgaaaagttgcctagacagggttggttcataaatggattgctctttcagtcataacaaaaagcgatacatcttcatagtcaggctaaagggcttagtaattcaccttatctgtgtatctcctaaagaaattagcaaaatcactgagtttggcgtttgtacttggtgccctggctttggtggaacctataatagtggtacaaataacacatgggagacgtttataatgccaaagcagctagagttgtaagtgcagcattataggagtagagtcatgtctttcttggagcatcaggaagggattcttagaagtgacatgtgccctggattaagtagaggcctgaggcatcatattccttcaactttccaggaaatctcaattatatctggaattagatgctgggaaataacatgacaatgacaggttgggtaaagacaatgaatgggtcaccaagaggtttgccatttatcttttaagccatggcatttgcagtgggaatatgtcaggatcagatttctggtttgagatcgctagagaagcagagtgagaatggactggagtggtagtgactggtgacagagagaccattttagtcttctccatttcactgagtaaaattagggagatagtaaatctattaaaaaggtagtctaagctgagctggggaaacatgacccccccatacaggcaggacacaataaatgactaataaaacagtatacatttaggtgctacatgatgttgtacagccttcatgtggtaaaggagttctgtgaagcaagtgagcagagaggtctggagttgataggcttggaaatttgtttcctcaaaatctcatgttgaaatgtaatcaccaatgctgtgagtggggcctggtgggaggtatttggatcatggggcaggttgctcatgaatggcttaataccatccccttggtgatgagtgagttctctctcttgcagttcacatgagatctagttgtttaaaagagctagagactgatatggtttggctgtgtccccacccaaaatctcaccttgaaatgcaaaccccataatcctcataatccccacatgtcaagggagaaaccagctggaggtaattgaatcatgggggtggtttcctccatgctgttctcctgaattagttctcatgagatctgatggttttataaggggcgccacccgcttcactcattcactctcctgtctcctgccaccatatgaagaaggtcagtgcctgcttccccttctgccatgattgtaagtttcctgaggcctccccagccatgtggaactgagagtcaattaaacctctttcctttataaattacccagtgttgggtatttctttatagcagtgtgaaaatggactaattgccgagaccagctgggtcgtggagaccttaacccagcggcgctagaggaattaaagacacacacacagaaatatagagtgtggagtgggatcaggggactgacagccttcagagctgagagccccaaagagagatttacccacatatttattgacagcaagccagtgataagcattgattctatagattatagattaactaaaagtattccttatgggaaacagggatgggctgaaacaaagggatgggctctggctagttatctgcagcgggaacatgtccttaaggcacagatcactcatgctatttttttgtggtttaggaacgcctttaagcagttttccgccctgggtgggccaggtgttccttgccctcattccagtaaatccacaaccttcagcgtgggcatcatggccatcacgaacatgtcacggtgctgctgagattttgtttatgaccagttttggggccagattgggggcctgtgcctgacactaaacagagacctcccccttctttctcttactcctgctctcaccatgtgatgcacctgctccccctttgccttccaccataattggaagcttcctgaggccttcaccaggagcaaatgctggagccatgattggaaagcctgcagaaccatgagcgaactaaacctcttttatttattacttacccagccttaggtatttcttcatagctatgcaagaatggactaatacagtagtcatcaaagtaaaggtgagatttgagttgactattgaaaggggaggaaggaataacataaattgtgtcacagacaaggattggttggtaggacacggagtagtgacaatcctgacatgcccatgttttatgcttcgatttgggaccttaaagtattcagccctactctagcaaaaatggccgcatacaggaaaaagagatcattctgtttgacattttgtatctagagagatttagctctgttgcttgttttactgacttgtaagtacactcattttgttctcacagtattttcttagcttttacattctggctactcctatttccacctgaacaaatgagaaatttagttgctaccaatgtctagccttagtactgctctgttctcagggttcagtgtttccttcaaacaatgtgttaggtaataatcaggtctgatacatgcagcatctgtgaactccttacttgatgctgtttgtttttaataaatatggtgtcacaggtcataggtggggatattttaataagtgacactaggatggagtacttactgactgctaggcgcagtgtgccttctatatgtgatctgctttttcccttttacgaacacgatgaggagggtgtttgaattgccatttttgtatatgtaaatagaggctcagagagttaaaaagcttgtccaaagtattcacctaggactgtgctgattaagaatcttagcactaacctaatttttatctggaatgctggatacaattgaaagtttatagttgaggataggaaggaccaaagattggagtcttatcccagatcattaacaccagttaggtcatgcatccttccttacctgctttgtataaaaaataaaataaaatttaaaagtgacactagaacaacgtttgtcttgttaatgtctgtaagatggtttccaaaacgatgagtctggggacttaataaagcaatttagaagcttttgcagtagcagtaacaggaggtgggtgtacatcagtgggaaagaaagatgtggatggctgagggaagaaaataaagaaaaacggatacaagatagagatgattgaattaggcttgaattactcaagggatgggcaagagaaggtagacaaggctgagatttttgcctctaaatccacaaagttcatgcactctgaatgagatttggagcattttaaaaccttttaagttttctattgaacatttttatcctccaaatcattttcttccagtgtgctaagattatagcctttagctaatggttttctctctcagttatgctcctaccatttataagcattaattttgctgaactgatatagtaaaaatgttcaaaataacatttggcagagcattttactctgactactcaagaataacctataatcttttctttttatactacatacacacacaccacacacacacactcatatacacacttacacctgtttttccaggatttacgtctttacctaaaattgtataaatttttccatagtcgagatgtataatttaaccttccctttcccaagggatgacatgtagccatttatttcaataagaaactccaagagcactagtattcacaagccaaatacagataacaccaaaatttttgctaaataaaggtgatgcatccattagcaaatgttgttgcttttaaagtgatggtttatatttaaaatccagtttaagttaaagttaggatatactgatggtttgcacatgatgagtggcagaataaatgagtcaaagttaactcagaggggctttgtttatttttttgttgttgttattttgcttttcctgggcatgtgggtaaatcatctccccagatgtgatgactgatgcttactgggcaacgaagagaaaatgtcacataggcattggatatgtgagtctggaactcaggggagaaataggggctggagttaaaaaacgtagagcctttgtattagttcgttctcacattgctaataaagacatacctgagactgggtaatttataaagtaaagaggtttaatggactcacagttccacattgctggggggcctcaggaaatttacaatcatggccgaaggcacccttcacagggtggcaggagaaagaatgagtgctgagcaagggggaaaccccttataaaaccattaggtctcagaactcactagtgatcatgagaacagcccgggggaaactgcgacccccactcccgccccgcccgattcaattatctccacccggtcctgcccttgacacatggggattattacaattgaaggtgagatttgggtggggacacagagccaaaccatataatccttgttgtggaaatgttatttaaacccacagactggataagctcaccaaaggcgtatgtgtacatggagtaaagggaagaatgactgaactttgaggcacatcatctttaaaagtcgggaaaaggaagatttaacaatgttgccaatgaaggagcagggaaagaagccacaggcagggagagaaatcagaaaatgaggacatcctaatggccaaggcgggaaaatatttcaagaatggagggatcaatcatgacaagtgccactgagaggtcaggtaaaatgagaactgagaattgcctgttggacacttaaggagaatgactttgagctttgtgaaataaaagcctgcctggaatgggtacaaaagagagaagggagggaagtgagccagtgagtacaaacaagtcttgcctttcacttgatcaggaggcaagatagcatattctgctacagatgaagtgaagtgggttgacttggtggtagaaggctaaggaagttctctcagcaagttaactaggtgagaatgaggggtgtgtgtgtatgtagtgccagagatgtggggagagaataaaaggtgtgagaaagtcacccttgataataagatagtaaattaaccaccaaaattggggccgccagtgccaagaactcacttgagggctctaattataaatttatagtaagaccagtcagcagagtcattcgtttttatctgcatcatgatacatgtaaggaggtgacagagatctgctgaaacccaacttgggattttgacaatggaaggacagaagtgtggggatgttcaactggatttatgtaaggtattataatgatgggaaatgaaatctaaatcagctaagaaagaaaatgagagcacgaggaaggttatggacgatggcactgtaatgtattatagtcaatggattggagatcccaagaggtcaagaaacaactaaagtgacagtgaatatactagggtaagaaagcttgaaagttacaaggtagtaaagtgtctgaaattgttatttttggatgtggcgtaataatagataacgatgagttctgaagtatgattaattaaggtaaaatataggacatgaacattggagaatggctggttaacaaactgagaaaccattttcatggttggaccatctacatgcttactgacatcaccaacaattatggcagtagccttatgttaaaatcaatgccagatgccaatatcatcagaggatggtggtggggaggctatcagaagactgtaaatgatggaaaccagaagcattcattgatagtgaagttttgcattttagggtatgaagaagaaaagaaggaaaatgtcttggaagtaacaattcggagcatgaattgtccctatacaaactccaagacttgtggcatgtggagaattaaaggaatagagaacaaaattcatcctttaatagggcttcagagaaaagttcttaggcgccaattgattttctcttcaagaagggaaggacatattcagagatgagattttcatgatggcatgccttgagtgccagagggtttggggagtatagaagatgtaggagcttgagtcccactaagggatcttcaaaatagtgtatgcttatgggaccaatgaatacagttcatctggaacacttgtgttccctgccgggattgataaaatacagggtctaatgggattgagcctattggtctcagttatggtggttcaaggggcagtcggggagggtgtgttctattataatcccattggagtaatggtcttagtccattttgaaaggtaaagcggagttggagaatgcgggtggttagtgatcacctggacatgtggagctcgtaagtaatatgggggctacagcgtgcagagtccagtgggcctacatttgaccttcctgtgagcagtactgaaggctggggaagacaagcctcaataacttgtcagactgagtcaggactgagattctcaacagtaatcagctaagaggtattgctctcctatcctaagagatgccttctttggcaagactgttcaactatgtctcattactaaaggtagacagaatcacttgggagaatccaggatgtggtactgttttgacacggtccaagctggatgatgtaagcaggagagaatgttctaccaaaaaccttgcaacatcagatcttcagctgtgcagccagtcagcacacagaagctaagctaaagagatgtggcatccccacagggaaagagaaagaagcattaggtaagcaactgcctcatttcccagcagtcatgaaggcagttttgctaagccatctcatagcaggttatggatcctgaatttctatgtattcccttagcccagaatcctgctttgcttttatgaacttaccacaaatgatgctcctgttctagagtctaggggagtgattccaaagtctggctgcagagtagaatcacctggaatgtccaaaataaaaatccagattctacccctgaacaattaagtcagaatctgtggggtcctggcttcagtgtttttcaaaagtttcctagatgattcttatatagagccgtggttaagagctatattctagggctcagattctgtccaactcctttggtttgacaagcaggttggctgctgctagaggactaacacttagctcctttctaggactttgcattttttttcaatgattcatagtcctcagactgactatcacatgcatacacgcatacacaaaactgtcctgctgtggtacaaaatgtgtgccttattgagtctcaatccagggacaattgcagcaagtgaagtttccagaggcctgggtatccataacacacacaggcatcccatccttgcagacagttcacacatggatgtgtgatccagtggcaggtctcaagaaaggaaagcttccaaagccaggagcttgactgagacagagccttgaggtcttggactggatctcccttccaggtacacactagaggcaggcagcttccttgtttcttcctctgctctggctgctgtttcattctaagcctctgcagacacattcttcatagctgagaaaactcacagatggaatgactattattggtgcttgtcaatccagaaataaaccacaatttgctcggcatttcaatctttaccactgatgtgttagtttcatttaattagttctgtgctggatgaggtcattagatttgcgtcctaatggaaacctattactcagctctgcatggtgaggagtgtgtaggactgatttgcattatctctggaaagaaggtgaattctctcactacatttgtggtgggcagcaggtcttccagcagaaacccatttgagataacactaattgaagggacacctgtcttttgagaattcttttaaaattttcatagcagattggctgtatgccctgagaaaagggtaaaaagtgtgctacttataaaacgcaattttggagaaaagatgtagtatgatagctaaaactgttacatgaatatcactgagtattttttaagctcttcctcttagaaccaaatttgaacaaattcttcccacacgttcttctagagttcacaaaatggaaagtggaaagtagaaatgaaaccacacctgtttccctcctggagtgagccctcattgaatctctgtagtagtgcctataagagtgcttttattttacaggggtactattatcattttcctttttcagaggagaaaactgaggcttcacactgtgagacctgaggcttcaagttactgaatattttgctcaagtcattgcttgtatcaaatggaacagatggaccccaaacccagtgtggctggtctgaaactttcctctttgtttttatactgcatcaaaaacagtttttcttgccctgatagaatctatgccacttaattctcaaaaccctgtcttcatcacatcccaccattctgaaatattcaccttcccttacaagataccaccatttgaaaatcgcaaaatatttttaaatctatcctctttcttatatattttttatcaagattccttctctggattctggccgtattatgaaaacagcaggtccaagtgtcattgggccaatgtaaaattgtgttgctgtattaagacatggacctaatgatcctggaaagctgagtgggtttagttatgttttgttttctttcctgtctaggacatcatgcaaagctagactacaagaaccagggattgatttcagtgtttctctgggggatggggtaatgggggatagatggtaagtctataatcaagaccatctctaaggaagaggattgatactctttccacgggtgacactgcattattttccatgtaaatggtgccccaagagtactatgggcagtcttgttgcagatctatttcatcttcctttcccctgccctcacctccctgctatttattgtttcccttcactgtcaaattctctgaaacattgtctgtattcaccgtgactcctttgcaatgcactttcactgcaatcctttaaaaaagtttgtcttcctcctacatttttctgataccactttctctgagaaattcaatgtataaatctaccagctcaggaatcccttcttaatttttctctgagactagtcactattttatccactctttctagaagttcacttctttctttatttttcagtttcactttagcctctaataggaggtggttgtctaagggccttgaggaggctgagcttgcacagtgatagttaattcttgttagtggctctccctctctagttcagcatatgctttcttttcctttctcataagtggaaacagtcataatgttctgctgttggatgtttcctggaaaagtctttggagagtttctcttcttctaagatttcagctaatgcactatgtggtatacagcttatctgtatctccagcctccacctctctcaagctctggccttccattggtcactcagtactcactgatcatctccatctagaaagccctgtggtaacccagagtcagccgaaatgaagacaagctcttcatctctctaaatatatttttgactctttatctgtagtctactaacttcatcatctatgcactagatagtagattgaaccagctgtaaactatgtctactagttttgtgcagtggttctcaaacttcagcgggatcaagaccactgtcatgatagcacacattgctaggtcccccttgagaagtttctgcttcagaaggtctggggtgaatcctgacaatttcatttctaacaaggtcccaggtaatgctgatgctgctggtccaaggaccacactttgaaagacacggatttcctgcacaagtctggagccagattgagttaggcttaaatcctaactcagccatgtgcttcatgtatgaatcttggcaaacttacatgaagtctctctgattcctcttctgtaaaatggggacgattaaagtatctacctcatagattttcttgtaaaaacgacatgagtatataagcaaagtgcttccaacagtttttggcagaccctcaaaaactgttagctataattgcacagcgtttactctctctgctttccttgtcctcactcccaacaaccaatcagctctcatgtcctaacagtctgcactctggaatacatccatttccttttcattattgctgtggatgggattaagtgtgtaatcacattgtcattcccctcactctactcatggtcatttaactgattggaactgtcactctctatccctgcttccccagacctcatactgttgtcaggttctaccttaatcactttaaagcaatcattacaaataggtcccttccttgcttagaaagtgaatgttgagtatattaatagggtatttgggactttccttgtactgagggcacctgggctgtctatgcatttcctctcatagcattcatgatatggaatctatgtttttgtaaatgtacctctttgctttcctgcttctgtaattttttacattatattcatttcttttgatatatactccccttcactattacaaggcagagtcttaattcattcttcaaggcctggtcaactttcctttgcccttccgaaggtatagcaaaatggtttcattcctcatgagaatgctgactgattgatggtagctgcttagagagatgacaagaattctggggccacatctacctgtgttcaatcacaaataatatcatggccagtgagcagtatctactgtagacacaggttaaatgcatggatgcatctgtaacaagtattgtctcttacgccatggagtacattttatactgtggatgcccaatgcattttggaaatctcacaactcagtaggcataacctgaattgtcaatgtgagtttcattttgattatgatagctaattttcccttcttcattccaggatgagggtgagaccttatctcagagaatgatattgccagccagaaaatcataataggcaatgaaaataagcctttaccaccttagttcgagaaagcaatatttggaacagggaaaatatattggttgtattggtggctacaggcttaggggtgaggtcttgggttttgaggtatagggaaccagaagaaagaataaggggatattctcccacaaggataaagaaaatcagagggttcttgggaatagctatttatagaggacttccatcatggagaactcctgattttacatgtgcaaggtagaaaagtgataaattccagctctgccacctatgagctatgtaattgggcaggtagttaactttttttgagcttcaacactattatcttaaaaacagaaatcatgatgctacctatcagggcgattgcaaaaattaaaggaaaacatatataaaacactttgtataatatctgactcaataattggttgttgttcttatgaatgttgtatggaataacaatcaagaaaatccccttaaaggtgttaaaactctttgcctcttatcccatattcctatattcaccgttagttatacacacataatgtcatgaagtgtctaaacaatactacaactactaactaattaactctaattgattggaactgtgtaagcaatactgctggtttactgttttcctgcaccaactagcatgagttgatgctgtgaaggtagagttttggtgctgctgtcatatttaatgcattcaaatttaaaagagaaacagcatgaatattacttagaaattcatacctttctaaggaagtttactctcttagattatcacactttataccttagatattttggcttatcttgttcttttcctgatgatgttattaaataccttgaaacacatgggttcataaatattgtaatttattcgttcaacaaatatttttggatgtttcatggggccaaggttctattctagatatcagagacataactgtgtacaaaacatataaacctactattctactggagattatcttctggagatagaatttagacactcaacaagtgagcaaacaaacaaccatgctgcaattttagatgttgacattttctctaaagaaaataagatgatggagtagagatgaccatggtagggtttgggtaatcatttttgaattgtggcgagagctttggccacatttgaattgatacctgcatgatgataaaggatgaagcaagaaaaaaatgtgaattctgagtcctctaagcagcgagaaaagcaagtgatccaactggcataaggactgaaagaagggccagttggtagctaccaggagtttggaaaggagtgttaaaaatcagtgctggaggggctggctgcgctgatcctggagggtgctggaagtcacctagggagtttggaattgcttgggtgcaagagaagccagtgaaacataaagatggtagcaagaaaaataaatttgattttccaagtgtacatgaacactgaatgcctgtagatctaaccttataaagaatttggtggctatttatgtagatgaagtggatactcacctgtgatttgttttctagattcaaattttctcccattgaaaaagcacagggtttacgcctttctactttgttgttcctgaattcaaaaacttttgagttcgtttttaatatattccatgacatattcatgtcatcctgttctctgacaataattttcagtgtggccctgatctgctacattatttatttctttctctttcccaaagctatcttgtgtcctctttgtatttctgtcttttatggacctgagaagatattaacgtagagattttgataaattgcctctgctgtccttggattacttcactttcctttagaaggctcgctatggccttaaaactgtgggcctgtttaaggttattaattcgttccagttcttggggagagcagcatgagcctctgcatgtatcatctggttgaatattctaacaatttaacaattgtcttttcgtctcttgtcccccacactttcaagttggggttgtcttttaacttcactcatagacttggacattcccttccatttcaaatagatgtttccaactcttgtgttatttctcttcttttattatatttgctgtatctacatattttttcaagagctgtacattactcttgactgttctaaattggcatgcctttatgttgacctcctgatcttcacctgtatacattatttgtcccaaggctttgattggctgcttagtcacattgagcacattcgctgaagctctaaagactcttctgtagagtcgacaactgtgtcagttctgtgtatctagtgccagaaaagtacaagggtgatgttttattcatactttgtgctttccttcacaatgacttgttaatttatttttaagttttcttaaatagttacattatttttatatgattcaagattttgaaaacattttttaaaatttaaaatggatatgattgaatttaattataacccacagaattttaatgggccatttgaaattgcaataattgaagaaaatgtttcaaaaatattttgagtgagcttttgaagtctctaacatacagtatatataatatccattttaaaaaattttcttaatgtgttgataatatgtggtttcttttacgaaaatactgtttttcatataaattcctagggagaactttgaaagaataatagtgattaaggaaagcatttaaataagaattaacccaaaagtagaagaaaatcagttaataaaaaacctagtcagagaaaaaatgccacaagttgtttttttcttctttgaaagaactttgatgatattctttcatttccccagccccagaaagaacaaagcttgtaggcgatgactgtgagccagacgaatcttgaaactctttgctcattcctcccaagtatcattcacctacaaatacataacttaattctatgcttctatttggaagagggaagctttaaaattattgcaaacgttcttgcaacggatccagttgcgcctgcctcattttccacctcctacgatgattatgatttcagagtggatttcagaggagaaagaatacatttctcagaaatgtcacttttattttaaaattaaaaaaatcatttctagatgttgcaattaatataaaataacccttcaagaatcataaaaagagaacactgacaaattttctgcaaatgaatgtgaaaaaattttagcatagcaaaatatggtggcagagtgtctacaaagttttcttcccatgctcatagaaacttcactgaaaattcaagactggctggaagattgagtgaactaaaaacctgcaaccttcttctaattctgaattctcatattaaaagaagaattagttgtcagatctagaatgattattagcctttattgctgctttcttcttaaaattttcacagtaagtagtttatttctgaataaaaatgaatgaaaattgctataatctattgtgtttggttattttatgaacaataatatgaatatgatgagaagtgtaagttacaaaaagagaccaagtcaaaatttaagaaacatttcattcataccatttatttagaaacactttctaattaattgaacactttattttaaagcccttggtgctgttagggaactgtaaccaagtccaaactggtaattagtaaaaatattaaaaactaaaattttaaattatttctcaagtggattcattttgttgtccctatgtttttgcatactatagtggtatttcatagggttatttcatcgtcccattaaaactatgctgcagtttccattcattacctcacttgatcagacaagacagaataaacctcttgcccaaagcacccaactagaaagggtgggagctgcccaattccaaacttcatgccttccacttagactagactctgcttcctctctctgaactcagttttcttggactgctagccttttccttttgtggaatattttctctgcctccatctagagtgtcatatgtagtttcctatatggtgaaaaataaaataattcaaaaaatgaaaggaaggttttaaagctccaatacagctttgaatccaataacctaacaatgaatataaacttttctatgatttaaaaagtatacttgtacatctattctttagattatcaatgttgtttagtgtaggtaatgcagatgctcagtctaccatcttgaattagaagcaacttatttattgcttaccagaatctttcctgagttgccaagagcatagagttaggaaattttgtaaacgtttaccttggacagtatctccttaggctgaaattacagtaggtggacagtaacaatatgatctttattttagttctttgatattggaatatgaattttctagaagggtcaaggcacttacatgacctaaaaaattagactctatttgttaataagagtctaacttatttcaaagcaaaaggccagtgaaggatcctcagggctggattaatgtgattttcagcacagagtgatgatggcaattatggtttccaaagcctgggagctgtgtgttttcagatgttggagagggaattgtttggaattcccaattccaaatgatttccctattgtttggagccagtagaaatactgactcttgtcagtatatttatttacaaagctcttgatgtatgcccactttaaagaattaactttcaaaaatcttaaagatataattggagtaagtttgttatatatgaagaaaaaataattctaagagttagaatataaaatgtgcagaatgtaactgtgcttttactttaagtttaggaggaaaacctaaacataacacattcttccaatgatattatgaatcatgtatgtcctgtcaaagaaaatgatcacttaatatgtgatattattaatgctttaatatgcaaatattctgcaaatgtcagtaactgaaggaaggagataaaatagtccttcaaaagttgaacatactcatacatactgtgcataggacacaattttaaataagattacgacctattcatttaatgacaacaataagttcgttttattcatcaataattcattttccaaagtacatatcatggctaaatattatttgaacataatggatacacacgagtaattgtcctgaattcctatataaatctattaacacaaagtagtaatgtaaacagtaaatacactacaaatacctgttcaagaatggccacactcttttaaaatattcatatattttgcatttagtttaaatgaaatctcattctacaaaatttgaataaactggctctaaaatgtacttcttattctcaattagaaatatagttcatgaaaagtgatttgtaaaaactgaaggaaaaggaatttttgtgttttcataagttattgtataattggctgacatgtttataaatccctttctccaggaagatgtaaaggaactcaacagaccaggttaacctgattcttctttgcattgtcacaaagaaatgaaacacagaattaaataaaataatgcaaccaatgttttaaatttttgcagtaaagaggtcaaaggagctcatctttaaatagaaataagcaccatagttttattctaactgcatagataacaatatataacttgtagaacataattttatgagttggtttggtggacaaatgtgtaattcttcttatgtggtcttatgtgggaccattcaggacaaaaaatgacatactgatctttatatttgcaatgcttaccatgtaatacacactcaaaatactttttaattgaacttcgtgtgtgtatagcacagaaaacttatcaaaccttaaaatgtagcagttaaaaaagatagtacatttccttccttagcattaggttaaattttaaactgttttaatttcctgaagtgtcttataaacttttagaattacaaaaaaatgtggtttttaataaaatatttttctccctcattattgaagacgatgttaccatacaactgagatggtttaaacttcagatgctccatagcagatatttgttttttactttctttcatgtcaggctgcttctttcaaattggtcattactagacattttcattgcaataatatttattatttttatgtcttttgaagcctttaacccagaaaggcctctaagtacgttttggatcataaaataaatggaaaaatctttaatcttaaataatcattagtttagcaaatatttctgttgatggttttcactggaacagagcttgctgatatgattgtaagtgtaggataaggccacccagttcagataattctcttccagagtaggacttctaagttggaaaacaataaagactataaggttgtttaaaaccatgcttattttacttatagataattcaggcattgacatatgtattatgtcatttgcaaatgatcattaagaatctctacttgggggatagataataataatcatatctttctcaataagggaatatggtaaaattccagatttagtagtggctaatgtaacctccttttcatggctctattcatgcctcattcctttcctatcatcctccatctaggtcactagcccttgttggagaatattgtatcctattgctccgtgctggtctgcttacctcatggccttaatattgttatgaccttgcaggaagctctcagtattctgtctaaagttgctcaaataatgtttaaatgtgcaatgtttatgctttagctggattccagccacagtgagtaacaagatccacatttttttcttcaccagaattccaggaagtggcatagtatccctctgagggaagcagtgagaaaaatggattggtctaccctcctcagcctttggagagctttggaggagtcaataagatgatagacttgatgttatgaaatgtgatttcttgccataatacttctcatcttcagtaacttcaaatatcaccacacactacacatctttgaggccaaagaaggaggaggtggaattcccttaccacacatatgtaagcagagatgaataggacaaaaattgatgaacgttttggggatggaccaaaacttgcccatcttttgaaatcacgatttacactaaaattagctaaacctccaagaaaatgaacagttacaagtgatggactacatatttttttttaaagcgttcttggtttctttcatttgactgcatgacactataaaatcacacaagctaagaccaggagaaggtgcgtgcagatgtgcttctgacttcttgaagacctacacatcttgctgaggaattctttgcttctttagtgagtggtgctgaatggaatgttagggctcctatagctataggggaaggttattttggggttattagtgatacctggtagctgattcctgattactctctcagactgtcttccctgtttcctctcttctgttgaaaatgttctctggcaggatgatttctgtcaataagagcaattggctttcctcgtcgaggttcgtgcaaacagaattgaaaaaagctgagtgagtgggcaggtttttgctggtttgtttaacaatgatttgagaactgaaactagagctgtctgaaataataaacaggtttctcagtgactggaagagaatggtgttttgttctttgttctggtccttttctcttttgacagtcctatatccttgactgttttcatggctctgtattctatacatggcctggaaatttgactgagggtctcatagctaaaaagtattagaagtcgtggccacctcctcacggagctctcttatttcctcttcgccttgacaacttctgtatttgctttaggtctgaactggaagttgcttccaggcttatcgcccaggtgagttaggtgtctgcttcggtttcctcacacagtattgtcctatgtgcttcttttacgatattgcacagcacatgttattacagtcatttcttcaacgtttgcttcctcatgggactgtgagttgtgtggatacaggagtcatagctactttgcttattgctgatctgacagaacctaactcaatgcccagtagagaaggtctcataaatagtcatttcacaggaagaaatggatttatttttggagatgtcattaccaaataaagccttctaggcagcagcgcccatgctggccatttgactcaaactgtgctgagggaagtatcccctggccttggaagatgagtgtcattttgattccagctctccaggtttttcatcaatgtcagcacctgctgaaaagaaccatcaaactggcactactgctgacttgtttgcaatccttttttaaagtttacctaaaaagaaaccataaaaagcccatcagattgtttttccaaaatccacatagacaataaaggcatttatctaaataatgttttggcttcacataacatcaataaacacttcatgaagattaaactgactgaaaaccttttatacttgtcaactgatttctgttggctgagttgattttctttataaagaatttaaaaagtaaagttgttttgcattaatgcacttagggatgtgtaaatgattttccttaaatcacatttttctgacaacgaacacggagtgaaagattattaaaactgatttctcatgaagttgtttgcatacctcaaacaaatatgtgaggctgtctccatcagtgaatgccatgtgttgatgtgattgatgaattataattaaccttggcaacatgttttacagcttaactttaaggatcaatcgaaattagttattctgaaagtcagtaaaatcgcttctatcctcagcttactgcaataagtaatggcctttctctggaagagttcttaaaatatagtgaacaaatacttagctattgaatctactttttaaaataaatgagagaccaatgggattggaataacttaatttgaaggagagaagtctccaggctgatttagtggctgttctatcaggagtttccagtgggcagggggatcagttctgattaacagttgaggcagttacctaattaaaacagggtgtatgaaagtaagggaagtgggatagtaggggtcagacatctaagaacctctcttccccctatccaatcaaagagaaaagctgaaaaaaatctttattttctgaatgtatatttaatgaaggtggagccatgtataacactaacattatagagtgatattaaatagggcacaagatatagatcacttaaaacaggtgggttcccttaggctcagcatatcaagtgacaattttttttttggtgtgctgccaactggcagagccttttgacaaatgtgatggaccttggaaaaatgataaatgtcttgaccttggaaaatccccttttggaagactttgtcctaaatgcttattcattataccctacagtaatcactgtcaaatatcaaaagatgactccttttatagctcgtgcaaagcttaaatactttagaacatgactgaagatgaccaaacacactctccagaaagttttagtcacctgaccatagcccctatgtttttgatggtcattgtaggcatttggaggtatcactttggacactctccttgaccttttctccgcaaggtctgtcatctccatttagactacacaaaataacgtaacttctctactcactcatcctgcatatcctctgctcccagtagggctctcaataaggcaattacttatctctgtattagcaagggggactctaattgcacctttgcatgaagcatgggcaattaactaaagggaagttgaagctttagtaactctccaatggcaatccatcctgtcctgtgccagcatggccacccagagcagacccatgcctgctttctgcggggggatgtgggatgtttggtcccagaaatattaaaaattactggtgttatctcataattgtagcctgattaaatagatcttattttttgttctatcttttgtgcaaaatggcccttgtacagaaattttctgagatactgaactatggaaataaccctgggattacattggtacttttctggactggaagacttggagtgacatgctgcaatttttaccaagttttgaatagatcatatggcttattttcttttaaatacttgcattgccgtagtgtaggttcctgagctaatttccgtctgggatgaggtatggtcttctgatgtccagtcatgggtccagatggtgatggtaagaaagatagcatgattgctgaatggcatacagaaggaaacagaatttatccctagtaaagagatggataggaacttactagaacaacaggatatcctcttgtgattaggagaggaggtattactcttcagcaaagacctggggtactagataagatgtattggcccggaggaaacaacagaagaagaaatctgttgcacagttaagctgctgtggttggtggttggtgaggatggagaggaatgtggggatggggtggaactgactccagggactcttttaataagactcaacgtaattcaacatgcagcttgcatgaggaggacagggacactccagtggctcctgtaattgagtcctgacagtgaatctaaattccattttacaccaagaaagtctagatggagccagaggtgctttccctgatatggccagatatgagaatcaagggagggcagaggaagatggagagagtgtgccctggcagctatcatctcatattctctggactttgtatttcccttgccccatgtcaggttttgtttgtttgtttgtttttgtctgtatcagtttttaattcatttttacattattcattgaatatattcatagagaaaggattgacagtagacatggctatttgttggatttcttctgtattttatatgtagccttttggtaacaagcaaggtggacatcctttgttttatttcacctaatcctaatactatgtattccaagcctgtgcttatatggctgtgggtctcaaactcatatatctacagaagtcaagcagaaatgtaaatcaggagcaggatagtgggggctgtgtccagctgaaggctgcttgcccagtctaatgaaactgatctagaggaggttgttctagccattttttctagaagtggacacatacgaggcagataactagattgttttaaagaaacattttaattttgaaaacattacatttatttatttatttatttatttatttatttatttatttattattttgtaatctggagggtttagctgacctctgggccaccaattcacctgcactgatgtgattgggagccagtgagagttgtggatctgtgtcttgaaaagtcacttcctttatgctagtgtagacccatcagtagtaggtcacctggaagccagggctctgcgtaggactcagggcagcaggactgaaagttgtgtaacacagcagttaaaaggagggctcaggaccagaatgcctgtgcttgaattccagtccagctactaaccagccatgtgaccagccaagttgatttatgcttctagcctcggtttcctcatgtaaaaagtggagaaaatataagtatgtgtttcacaaggttgttgtgatgattaaatgagttaatgcaaattagcgacaaaggtatgtatgcatcctcactgttaggaacgagggagcaagatgggacatggtggtcccctgagtcgcagtcagtgaggcagctgtgtccatgcctgtgggatgcttttccactagcacctccacaaaatttttaattcgaagggtaggatgagggatctgagattttaaaacacctcccaggtgacttctgcaagaaacacctgcagaggagagagagcttggtcactggggtccgatcctggccccggtgtttactaacagtgttgccttgggctgatgactcatcccaatctctttggtttccaaacgttcactaatgcgatctgctctgtgaggctgatcatctggcagagctcatggcacttaacacagactctacaacacgagttctcctgtcttctcggtcttaatctagtgcaagtctccccaccaagacttgggaaacactcctaaggaaacaaagaggaagaaagtgagatcccaggggtgaagattggatcctttgtgtgcttagttctgaagtggaatcaaatcacttcagaagttggttgtgtgttggcctctggtgaatttgtttcacaatgccatgtaggagtacatccgtggcttctcatatttgtttgcctaactataattgagcagcttgaattcaggctacatttttaaagaaaactagtgatcatattcacatatgatgctctggcagtacacagagtcaagttttcactggaaaatagctattaaaacccagcaatgtaagttttcctatgcaaccttgatttattattttgtcaaatatagttcaacctatatatagccagttaggagcaaaggtgtagggtaggaaatctctagctcggttcctatagtatccaacattctataagaaaacatgcacacacttatcaacaggttttcaataatgaaggcaccatacaacccatgataattatactaaatatactgatgcttatgattttctcatgctgtgtatctggaaggagcctggtgtccagcctcatactgggtcatggaagtagcctgttgtgtctccgtgttctaccatttatcacagggcatcatttctgcatctcgagtcccaattcacaaaattgaaagatctctcaggcctgagcctattgttgttttatctttgaatttttgacaacccagaacatgccacatttcaggaaaggtttcttgaatgagtgcataaatgaagctttgataatgatttgacatttcagcatcttctggtttgctcgtagtttgctaaggaggaaaatgaaaagagagaaagttagagagagcattgcgagcattgcgatttccaggatatacttttataatgagttgttccaatacagactgcaagctcagaactttgaattaactggcacccattgtatgccacctgatgttagtgacaaatgtacccacttcagaacaggagccaatatctgcgtatcagggagctgcagagatgacagtgaaaaggtacatggcaagtgatgaatggtcagatgctaatgccagcaagccctttgctacagagatggagagtttaattgttcccactttgatttcataccgcagacgccataaacatcttagtttaatcaaccagaaacatgggctgtcatagatttaaattcatagcagttatgggtctatatcaaaagctatagagatgcttgttacacacagatacaagaacaggaatggaaagcactgatgtcatccccatgggttaaactggactatctgtctatttttcctgcagggtgaggagtttattaacaagaaacagtgtttatcatactaggcattcagataaatccattttccatttaatttattcatttggaaaggtcaacttttccaccaaaacaatttctgtttctttaatgatttctttaataactttctgtatttttgtttgtatttctcttctctcatttaaaaaaatctcttttcaatatgccaatttaattttagcacacctaatacaaatggcattgaaaaacaggtttcttgagtgtctttttttctttttaaaattattctcatcacttcaccttaggatgttttgtaagcgcatcacatgtgtttcatgtgaacctcactcagtactggatctttttctttccatttacatcctaggaagttattgtttcccattccaatactgtatgcatttttctttcctaattggcgcttgctagtagacagaaaaacattacgtttaaaatccatttggctttaaattaatattttagctgtatctgaattatcccatgaggccatatttatcttggaaaacagattgtggttaaactcctgtttctaacttttatttgtttggctgatgccatctttctgttcagaaaaggagttagggcagttgtctccttccactaggccttgaatagcaaatgtttagccccgagcaaaaaaacataactgccttctgagatgtttcaggctttcattcatgctgtagatgctaattttggaggaagacagaagcttatattcacacagttactaaaagagcacctgggtcagggggtggagactcggtttaccaagttcttaaaagacaacatggctcttctgacttcagcagataaagaggaatcggggcattttcattcctggatcaatcccacttcttgttcatatggtctgtttattgcaccagccattaaccaaacttatgataggaaagtgcagctagtttttcaaaataatgttttaagtcttctttttaaaaaataaccaattcccccaggatataatagtctaattaataaactgatgaatgttataatccattagacagcattatcccgagatggaagggataggtattatttaataggaatgtccagagcagagtttatcagtactttcttgtcacatgaaagtacagttcctggctcagaacacacgccaaggctggtggccagagggaagaaagaagggaagaaaggagggaaacagttgaagccactggctgctttcttctcaagagcatgctttctgttcaaagcacttagtatgtttgcctccaaattctgaactcctatgacttcctgctaaagcactcaccttctttttatttagctttccaaccacaagtcagagctgccctacctcagaatagagcttctttattccttcaaattcccaagtttatttacatggaaggggcatactgctcttgttagaagaatattaagaatatccttgaggttcccaagaattgtacaaataactgttgattctttggtgatagacattctgattttcaacatagaatggctatgcagagtagagggtgtctgttatgtgttgattctacaaacagaagaactaaatccacctgtgtgttcagttttttatacctttatgtcctttatattcccaatgggggtgaggagcgcaggtaggaagggtaagagtctaagaaattgtgctaaaaactcataagcttttggtttcaaaatgatttggcaaaggaattttatcctgagggacctgagtttggggtaagttttaaaggaaaatagtgaaaaagtagcaactatagattattagttacatttaacatttcatgatgggatggtggtgtgtgtgtatgttgacacataatgtgtatgtgtatatgtgtttgtgtgtggatatatgtaggtgtgagtgtttaaggtgggagtcttttgactccagcttttatcattgaatgcaaagggcagaggaaaattcacacagataattcgaagtttgaacatttatattttttgtctttatatctcatattcctaacatgggtaacaatgtgcagacaatttaattcttttatcctcagatataagcatttatttatttttatttacttatttacttattttgagatggagtctcgctctgtcacccagactggagtgcagtggcatgatctcggctcactgcaacctctgcttcccaggttcaagcgattcttctgcctcagcctcccaagtagctgggactacaggaatgtgccaccatgcccggctcacttttgtatttttagtagagatggggtttcaccatattggccaggctggtttcgaactcctgacctcgtgatctgcccacctcggccttccaaagtgctgggattacaggcgtgagccaccgtgcccagttagatataaccatttcttataggaagacacaatctttgttgaagaatactttgaaagaactgcattaaggaaatcctgatctgggactcagggtgtggcacctagggagcaagtgagaagagttaattaaagtactgttatagcaacagaactgggcagtaggaactgcaatgtcactgagaagaggaaggaggataatagctggctgatagagtttgatatgtgtccccatcaaatctcatgttgaattgtaattcccagtattggaggtggggcctggtgaggggtgtttgggtcatggggcaggtccctcatggcttggttctgtcccggtgatactgagtaagttctcatgggatctggatgtttaaaagtgtggcccctgccccacaagtgctcttgtgcctgttttcgcctgtgacttgcctgcttcctgtttgttttctgccatgggtaaaagctccctgaggcctccccagaagccgggctgatgccagtaccatgcttcctatacagcctgcagaactgtgagccaattaaacctcttttctttgtaaattacccagtctcagatatttctttatagcaatgcaagaatggcctaacactcagggtgagcatgaacaagcagggagggtcaaagaagaggaggtctttggtaggagtatgggtcagggagtggggtgagggtgggcagcatcttggaagagggtagataatgcttctctgagatttctaaaatatctttagtttttattgttcatgatctttcttataagagaattatttttggtagactcaaattcaagctgtgttctgggttcaggctggcacagattaaaaactgaagctggtgaaggagtggccacagctggagggaccactgggattctgttttcttgagactttggtcccgacctatatggtgaccattggtccaacataggttgggaccaaattctcaagaaaccagaagacatggttcctccctcaggttgctcacagcatgccatccagtggtcccttgttgatcatgattatcgggagtaaattctgtgtcaacaaagttgacctggctatatttaattcacccccaaatcaaggccagtactcaagtcattttagtaaatttctgtggatgcagtactacagatatgtgattataaggggagccccgatggggtcccatttattcctttatgattaccaggagaattgaaaggcagatctttttttgatgaatgtgaatttctcttactatctgaattgtggagcccaattccattcaaataaattatctatagatttactgaatagggaaaataattttactgtttattgagaggctgttgtatgctacccttttcacttacattaatttatttaatattcacaactctcctgagtggctattataattcttattttattactgaagaaactgaggattagagaggttaagtaatttactcggtattattcggttagtaaatgggaagggcgcaaagctcagaggtgtgtatggaaaagacattgtttttcctgggctgtagagggctggaagtgctttcactgaggctcaggcagtaggagccgggcagcaaggaggaggcagcctgaacatgggccaggatgctgtgccgtgtgggatgtgttcactcagtcaacaaacatttattgagtgcctaccacatgccaggcaagtaggcaaggtatgcctaccacataccacatactgctccaagtagggtggataaaaaagtgaacaaaagaaatcctctagaactcacgatccagtggaatgatgctgtcacaaatgcaatgacactgactcaatggtttgcagcagcacccagaccatctattgttgaggggtttgacattccttctgatgactggcacatcggagcatgctgacttatctgcctacacactgtgttgtgaaacacacgattgtgagatggctcatgagtaatttgtcacattcctacgtatcagaactggtcaacctataaatccacgtttggtcactttagcattaatagacatgctgtaatgactgctggacttgggcacctcttcccaccttggacaatgatttgtaagcacctgtatctttagtagaagtgctgccacttccatccttgatggccttgatggcatctttccaggagcactgttctcttctaagtccatgctgctccctgtacttcttggcttttctgtggtataaggtcccagggagggtaggacattgactttttctctaactctttgctttagtttctaaacctttgtctttgacttcgctttctgattccacccttcacgccatcagctctagagacaaaggtaacaggacaaagaatcagggaatgaggtgagtagtacctgtctctctgtcccccttttctccccctcctcaggcaaaatcccttccctccttcagctgcaatgagacatcagaaagggccaacgacttactagttatcttgtgatccatttaggaaaagagcaaagtaattgcaccatggttagaatactcagtatataaacaagaattcaagttctaatatctgcgatagacttattaaagaaagaaataatagtagattagattgaagtttatccttataataacttgtctcttgctctcttgcattcacatttgttttcttgagatgagataaaagatttaatttactgagaatttgttatgtatgaaaataatattcatttcctccagcctttcaatttttttgtcacgaagttttgtataatatatacctttatagacatattttcatcttttctacatatgtgggaatgccaaatgaaagccatttttcctcaatataacatttttaacaagagttcttaaaataatgattccccagttaatgtatacatatacatttgcaaaatagcaagttcatttggtaattgcagaagaaataatggctttaataaccactgctccacttggtgtctgcctctaagcattgttaggacagcaagcatcaggcaattccccatggccctgttttctgagaaggttctatttatgtcttccgaattttgactatattttgacattttcaagtaagtgtatggcatctgttgaataaatgatcactcaaaatggatttgcctcaattatcacctaggctttaatctctctaactacaaactcccccttcctcactgttgctggcagtgacacctgcattcctgctgcaccgtcatccttgggaagggctttggagttgcaatcagcatccttaagagaagagtacttaggtgtagtatgctttggctgttctcataagtcgttattggtcagcctgaagcctcactgttacaattactttgtctaattatgatttttgctgtcaaacttatgttaaaatttcagcaataacagtttatttgttcagtgctctcactgcattataaacatgaagttttcacattttgtatgttttagtaatcatgaatgactttctagtattgtccacattatatatttgatatctatttatactgcgaattaacactgaaacaatgaactaacgtgattttcttgaagacaacacattgtgttcagttggttctctgaaccctaaataaagctgaaaagtgtattaattttggtatggattccctaatgattgcacagttacttgtatatattttatagctgtaaatcttggtggataaactagaattagcagtgctcaatgacttcaaatgattttttttttttttgagatggagtctctctctgtcacccaggctagagtgcagtggcgcgatctcggctcactgcaacctccgcctcctgggttcacaccatctcctgcctcagcctcccgagtagctgggactacaggcatccaccaccacgcctggctaattttttttttttttgtatttttttagtagagacggggtttcaccatgttagccaggatggtctcgatctcctgacatcgtgatctgcccgcctcggcctaccaaagtgctgggattacaggcgtgagccaccgcacccagctgacttcaaataattttaaagattatacacacacacaaacacacacacatacacattatttttcttttgaactgaaataacacctggtttcaattgttatacatgttttctcagctagtgctattgcagttgaaccataatatatataaagacaatatgtggatcctagaggtaataaattatttcagcaaggttgtagagtacaagattaacaacacacacacacacacacgcacgcaccagtcacatttttatatactgaaaatgaacagggaaacaaaaattaaaaatgcaatagtatttataattactccagaggaaaagacgtgattagatgtaaactttaaaaaacataatctgtacatactgaaaatttaaaaatgctgacaaaagaaataaaaaacatcttaaataattggagagacatatggtgttcatgtactggaagtctcacatagtaaagatgttaattctcctgaaattgatagtcattcctataaaaatcttagcaagatcttttgtagataagcttattgtaaaaggtgcatgacagatcctagaatagttaaaacaatgttgaaaaataataaagtgggaagaattactttgctgaatattaagcttattatagaactacagtaattaagacaatttggcagcgagagagacacaaatcagttggacagaatagaaattctttaaatagattcacaccaatttgcccacatgatttttgacaaaggcacaaaagcaattcaatgcatgcaggatacaagtttcaacaaatggtcctggagcagtcagatattcataaggaaaaacaatcaaacaaacaaaaaacccaactgaacctccacataaacctcacaccttatataaaaatcaactcaaaatgaattatcggctggaaacataaagctataaaacttttaagaaagaaatacaagagaaaatttctgggatctagcattcaacaaagtgttcttaaacttgacaccagactcaatacataaagggaaatgttgatgaagtctactttatcaaaatttaaaatgcttgtctgagaatgagcttgttaaaagaatgaaaaaacaaagtaaagactgggggaaaatatttgcaaaccacatatctgatgaagaataagtatttagaatatataacacagtctcaaaactcaacagttaaaacgatcccattaaaaatatggaccaaacacattgagagacatttccccaaactgaatatagagagagcaaataagcacatgaaaagatgttgaacattattatcattaggggaatgcaaataaaaaccacaattgatatcaatatatagctatcataatggctaaagttaaaaaaaaagaaaaaaggaagtagtgacaacaccaaattctgacaggcatgcagagaaactggacctctgaaacatggctggtggaaatatatttggtacaaccactctggaaaacagtttgccaatttctttaaaaaaacctatccatgcaaatatcatatgacacagtacttgcactcttgcatattaacccctgaaaaataaaaagaatattcacatagaaacctctacttaaatgttcatagcagctatagtcagactaaccaaaaattaaaaacaacctagttgttctctggttgttctttggcaggtgataattaaacacactgtggcacatgtatattgtagaatactactcaataaaataatgaactgttgatacagtcaacaacttaaataaacctagatggaattaatgctaaatttatcaagccaattttaaaaggtcacatacttcatggcaccatttatataacgttcttgaaatgaccaaaatatagaaatggaaaacaatgtgtagtttccagggtttaggcaagagttcagagtgggagggaagtgaggaagcttataagagggatccttatggtgaaggaatattctgcatcttgagggtgtcaatgtcaacagctttcttgtgacactgcattatagttgtgtaagatattacctttgggagaactaggtagagctacatgggatcagtctattatttcttgcggctgcatgtcaatctgcaattatctcaaaataaaaaattgaattcagacaaaagaaacaatacatggaggaggcttttggcccctgtgggagtgctctcttgattctcctgttagagagagaactgtcttttcaggtacaagatgggctcctcagcctccgtcccagatggtctacgttgagttcaattttttgttaagtcaagaagatctgtacttagacggcagtataaatacttggcagacactgcaaaaatgacctcagtacatacaatatttgtcagaaagcttgcttggtatcagcattgttcagaaaaaaaaatacttgaagaccacaattctaaaaacttatctctagagcaagcctagagaggagagaactgagtgcctaagttcaattattattgagccatcatgaaattgtgtttacagaatcacactttggtgatcctagaagaaatatcttcctttagtcaaagaatgataaaatttctctgaggcattaaatttcctatgggaattgtgaattatatgaccaatttttctccttctcttaggctactgaaattctacagctaatttgatttattctgtagcaatgtgggggtcattatatatgattgttcaggcatgaccaactatttttccttggttccccatcttacctttaattaatgtatcttgttaaagtttctgagtctttagaagctgccttaaatctctatgtgaataaataaggaataaagataaatttatcttgatgtacctgcttcagcctcttaatatctcgtaattgcataggactgtcctggaagcatattgaaaaattaaaacaaaaaaagacttctatttctggaatttttctatgcctccttcaaccttgtatttagcaagcatatttttgcaatttttttttctttctctatcttgacttcctctctcttgttagccctctgatgaatgggccagtttgaatttgctactctggtttttggcctttgacaacctgccagcaaatgccccgcttgtcctctcaccaaggatgagaagtatcccatcctatgctctccctcagctctaagggatttactcaaaaagagaaagagcaattaggccctggacatgcattctaacttaattttagcctcagtcttctctgatggaaaccatgctttaaacatttcactccccactaaactcagttcatatcacaaatcctcttcaaaataacagatttatttaaccttaagtaaaattaaccttggattgatccgaggtgaataaagcattttagttataaatggaaagcattgagtctgccatttctagacccatttctaagatgcctaggatgcattagataatttatataaagtgatgttgtgtaactaataaacacatattctactgatgaagtgtgtgtgtgtgtgtgtgtgtgtgtgtgtatgtgtgtgtttgaaagtttggcagttacacatacagtcatatgccacctgccacctccgtattgtgctgtaagacttcttcagtcatccttaaggaagtgtttgatccctctttcttgttacatataaagacaatgcactttaaatactactttaaaatctgcatcagcgttatatgcctgcttggccctaggctccagcttcaccacatgattttctctccaaatgaaatatacacactaccttgggttcttctgtgatttttcctgtctactcacatttctttatttttcactcttggaatatctgaattcatcatgcataatttctgctgtttcatgtacttgaggaatgcaaatatttgagatctgcagctacagacaaatcaatagccttgtggttccatttgttcccttctagcttttaattctgatttttgacagtttctgaatatggtaagttatagccctgcattactaagagcaataaaatataaatatatcaattcctaatgaatttaaataacttgtgaaataaatcaaggagcccggaaaatttaaatgataaaatttaaggatgagattcatgtgctatttgctgactaatgtaaaaaaaaaattcaacctgtttatgactaatgttaaatcttaaaatttaaattgcacatgaccttggtctgttttgtttcactatgattatgactaatccctcccaaatttataacagttgaactaatgcaatgttgactgtcaacagttgaattcctaaaacaaaaataaatatgactcgtttcatttaagatgtagatgggattccatggaaaaggacaaagatggatgattatgctgtaatagaattggttggttgccagcgataagcttcaatataagagtggcaggtgcattgtagtggaatgaacaatgagcctagtgtcaaaatctctaacagtatgacctcggtggagcctgtttttgttatcgagggtacatttttaatagatgagcccctctggggtcttgagtaaagtgaagaatcataaacacattcactattagaatctgagggactctgtcatgtcgtcttccataccgctggagctgggtctgcctagttcccgaaatggacactccaaaaatatcttataggaaaaataaagaaaattctttcttcctgtgaaacctttcagccctctccaattattgtcaaatacagtgattttattcaggaggattcagtctgctattttaacctctggctttaatgctaagtattctagcctaatatttatactatgtatattttctcaacgtcatctaccagtcagtagggtaccttggtattcattttcttctgaatttatttactaattcaacaaatacttattgaattgtttatgtggcaggagcagtgctaagttctgagaacccaaaagtaaaaaaggacaaaaaaaacccctattttagggagctttaaaaattacatggatacatgtaaaattactatagtaagtgctgtgaagaagagatcctggtgcagtctatgcatataatggtagcttttactgatcatggaggtgagaccaggctttcctgaggaagtaattgttcaccagtatctaaaggatgagcatgagtaactcggtaaaaggttgggcatgagcatttcaggtgaagaatatgacacgtgaagcagtcgtgtgtttgagaggggtgtggtaaatgtaaagtcagtgtggccgcagctcagagaggaagaggaaggctggagaagtagtggtgctactaatgtttaaactcgtcccaaaggcaatgagaaaccatcaacgtttattaggcagggttgagagtgggtgaagtgacatgatctcttttgtatctgacaaaccatccttccttgcatgcggagactggctgccttggtggatgcaggtggacaaggcagccagtggagtggttgagagaagagatattcacggctaagatgatggtggtggtggaggaaagcaggtgacacgagtttttattggaggataaatttgcttaattgttaatttaatttatttttattgataaatagtatttgtacatgtttatggggaatatgtcatattttgaccatgcatacaaattgtaatgatcaaatcagcatattcaggaaattcatcacctcaaacattcatcacttctttgtgttgggaacatttcaactcttttcttctagctgttttcaaatatacaatacattgttgttaactacagtcatcatattgttctatctaacatcagaacttattccttctatatgagtgtatgtattttttttttttagatttgggggatatatacatatatttgtttgttaaatgggtatatttggtgatgctgggatttggacttctagtgaacccatcttctaaacagtgaacgtagtacccagtaggtagttcttcaaccctttactccctccctcctttcctcccctcttttggagtccccattgtctattgttttcacctttatgtccatgtgtacccattgtttagctcccatttatacatgagaaaatgtggtatttgattttctgttgatgcataaattcacataggacactggcctcctgctgcatccatgttgctgcaaatgaaatgactttattctttatggctgcatagtattccatggtctatatgtaccacagtttctttatccattccactgttgatggatacttaggttgattctatgactttgctattgtgaatagtgctacaataaacataaaaatgcaggtgtctttttgataaaacatttttttttttcttttgggtagatactcagtagtaggattgctgggtcaaatggtagttctattcttagttctttgagaaattgaatttgagaatacatttagcagggcttggagagtgggagtttaggaagctgatggtgaggatcagggcagatgactgccagtattgcttggaatatgtaaatcaaccattggagaggagggcaacatgtataacattataggagcttttgactggtttctctgcttagtagggaagaaaattcagaaagaacaagtgtagctccccgattctgactaaattcacccataagaaagcccctaaagttttctgacccttcactttgctgatgtattttatgcatatgaaatgatacaggtgaaaactctttgagatggatcataatgtataaatataggttattataacatattataaataattgtattacattttatatattaagtatacatatgtatataaggcatatgtgctattgcacttttttattgtatacattgtattgtttttttccttcaagaagttcatagaatgacaatattattttgtattaagaaaaaatctggaccaggtgtagtggcttgctcctgtaatcccagcacttcaggaggccaagacaggcgaattgcttgagctcaggagcttgagatgaacctgggcaacatggcaaaaccttgtctctacaaaaactgcaaaaaaattagctgggtctggttgcatgtgcttgtagtcccaactactggagaggctgaggtgagaggatcacttgagtccaggaggtggaggctgcaatgagctatggtcttgctactgcactcaagcctgggcaacagagtggagattctgtcaaaaaaagaaagaaagaaagagagagggagagaaagagagagataatgacagagagagagcaggaaggaaggaaagaagggagggagggagggaggaaggaagagatggagggagggagggaaggaagggagagagggaggaaggaaggaaggaaggaaggtgtggaatctaatcctcagatctatttcttaactatctaaaagtagtgtgttaatggtgtgatgcttatttattaaaactgaatgaatggatggtaattttgttaacatttagcttttaaaatctagtgaatatatgagctcattttactatataacacatttaacatttataattttattaaattgcaaacagactcgtaagtagacttttcttctctgtacctttggcaacatatttagaaggcagttaaccatccattgagatggaatataaagagtaagtctgaagtttacatttagattttgacagtcatcattagattatgcaaataattaaaaaaaaaccttacctcttgctagtatctgtgctcagtgtccttccaactccattcctttctttcatgttaacatatcaaagccaatgaggaattctatgctgtgcacagaatgccttgtctacctatggcagcaagggccactctgggatatgatatagtggaaattaaagaaaaatctgcctttactccagttttaggatgttttgaggagaggaatgtagattccatcttctcatacggaggtgttcattggggttgtgggagaggccttctgtagaaagagctgaggtcggctcctcaaggagttggcatagcaggctgcccagaataaactgacacctgatagattggagtgttcagagagatggaggcttccatggttttctgaccctggaagtatattgagatccagtgacatgccgtgggcccaaaggggagcaccccacccaccatggagattgggtttaaaatgatgggtcagcttctagacaaaagacctggcaaaaacttagggatctgcagccaagtgagaggcaagaagagtggctgagtcaaggatgacaagagggctgatgttccctgaggtcagaatggttgacaaaataagggattggagtgctgttctaagcacttaacacatatttagtacacctaatctcttttcgcacctatgaggtaattactcctaaaacttccattttgcaaatgagaaaactaagtacagaaaggttaagtaactttctcagtatcacacagctaataaatggtaagccaggatttgatgtagaaatctggccagcaggctgtgttgcaaccactatccatgagcacaaaatccacgagccatagcgaagaggccagcatttttaaaaatggccaagtggaccagggctccaatccagccctgttttttttttttattgttgttgttagtttgttttgtttttttgaataatgctttactgaaacaaagtcatactaattcatttttgtattgccagtggctgctatcctgttacaatatcagagttgagtagttgtaactgacaccctgcgggaggcaagacctcaaatattcagtatctagcccttgcagaaaaagtttgttgactcttgacgtgggcaaaaattatcaaaaccaccaacgagaagcactcaatgagagacaagggaattccccaattccaagggatgcaaaaaaccatcaatgtattttagatgactttttatctgtagaagcagaagagatcattttatccatgggcaaccccattatacctgaaaagacatttaactactggctcggcctaaagtgtaaactgtaaaccagattggatatttaatcaaggggctcagaaaaaaatgacaggagtacacgtgtacacgcacacacacacacaccatgtgtttgtgtatatacacacacaaagaatgtcaactatatatacaaataaagaagtgtaaacacattgttagtttggggattaatatttgttatgagttagtatttgtcttatgttaataaagaaatatttatttgagatacctgctgaaatattgatgggtgaaattgatatgctgtcctgaatttgtcttattatagcaaataaaatataaaatatgtttgaggagtatggtgcaaaagaatagctaaattaatgatcattgttgaagctaaagtgattaatagatgatggtttcttataccattccttttacttttgtgtgtttgaaaatacccataatcaaaagttttaaaaattgcaatgtaaattatttagacagttttcatattttaccatgaagtgaatacagaaaaattaagtgatttcattacactcttgccataatgttcatcccttattttctttgtactatcgggaaagaactagtgaattggttcgaggcatagctaagaaaagaagatgagacacctattggggagttaaaaattacttaacaaatttgttttgccctgtttgccgtcaccacaaacatgaactgaagtgcgaggagtggcaaatggtagggaaatttatatctacagaaaatcacaagctaataaagagttccctaatggattctcttagattcccagtaggtagattatgaaatggttgaatttcacatcaaacccattggaagggtggcagatactctctgagttaaaaacacacacacacacaaaaacacctttcagcctggtgcagtggtgtccacttgtactcctatagtcccagctactcaggaggctgaagtggaaagattgcttgaccccaggagctcaaattcagcctgggcaacctaccaagacccccatctttaaatttaaaaagaagaagaagaagaaaaaaagaaaacaacttttaaagataatgttcctgtccttaaaatgaggagattaaatgtgcattaaaatatctcttgcagcaagtaatttggatatatttcatcaatatgtaatatttgtgctgtgttttaacagtggcgtgtgacatctgttgaaataaaagttttgttatgtcagtcaagctgacagtaaaaagactgcagaacagttttctgacatgctgccctaccaatttagccctggcactataatttccattttgatttccaatttgatccaatgattatgcattcctgcattcttaattttcaagtgtttatgatttctcgatgtattaaaatatttatgtctctatttgaagaactaaaattttctatgaataaatagccatttattcttttaacaaatactgtcttgtgccaggcactgttgcaggcacgacagcaataggaaggaacaagacagaatcctactcttttaaatgaaattgctgctatagtattcactacaatatagggtagatgaatttatctacatcctagtatggtttctgtttactgatactaatctattctgaaagaagcaaattaaaatctcccactacaattatttttatcacattttctttgcattttttgatttatacattcagtttccatttttatttatatgtatatgtatacacatatattcctatatatatatatatatatatgtaaatagttgcctttatttttaataaagaagcactttaccctgattgtacttttaagcttaaattccaccttgtctgaccctgatattgctaattatgttactgttactaacttttgttttggcctgctgtattgttgcccaggcctttatttaagctattgatcatcacatcacttttttgtgtatttctttttggaaataacaaatggcttggttctgtttaacaatcttagttaatagactaccttttgatatgaaaattgactccatttagagaaaaggtggcaatatgtgtaatttttctctttctgtttattttatgttatactttttactgtatgttttcttttgccctttcctattttttttttcaacttggtcaaaatactatttttattttcctacttgattgtttagcagttctgtttttgactccattaaaggttaccatctgcagcagaaaaagttaatgtagtactttacatgaaatttttgctgaaacctgtatttattttactagcattacttatgtaagaaaggaagaagttattgcaaaaaaaatctatatcatacccacagttgcatatagcaatttatattaaagttaattacaatttaaacgtccattcctagccacaatttatcagtaatcatacgtgtttgttggctaccatattgttaatagtgcagatttagagaacattttgatagtcacataaaattctgctgaacaataatagtatactttgtataaactatatataccatgtatatactttgtatactataatgcatacattttgtaagtttgggaggtaattgttagtaggttaaatattaatgattaataaaaagttcaatttcctaatacaaacatgaaagggcaatacaatttcacatcacagaccttttaaaataacatcagagtttaagtgaggattatttaacaataaattatttaagttaatgaaggatatcccaagagaacttcttgcaaacaaactagccaggactcaatttcacgatgacaagatttcgagtaactttaaatgtgacaagaaaggacgtttgccccaatgtgtctaatgcatatacacttaatgtccttaagatattggacttgtaaatagtctgaagcttttgccattatttcaataatgggtcctagtgtctagcttaaggcaatgtattcttaaggcactggtgtcaatggtttttctgttttttaagatgattcattatctgttcaatgaaacatgtggcctccagtatcaaccacaattttatctgaagttggtgacaatttggaaactctacattgtatttcacttttctagcattaataatcaaacacatatctctctactattagatggaaatatctctattttcttcaccaaatactttcaaggctgtttctcccactcaagtaagataaactttaaaataggcttgatgttcactccatcttccacctcaaagcctgggttttattaaaatagttcagtagttctatagtccagaatactttaagattatcctgtcattacacctcttaatttgaaaaatctcatatatttccagatagcctatgcttattcatttacatactactgtgcgtgtataaacacacacacacacacacacacggaaggacacacaacctaccactcttcccccttatcctctccaattcatctgaggactctattatgatttgagtggggaggtgttcttatatcattccttgaatattgtcatctgatgtggtcagtgactgataaaaatgtttaaagtcatagtctttgtaattacaaaattagaaaaacacttaaacactgttaattagaagatgagtataaatgcgctgggtaaatgtgctgggcacggtggctcacacctgtaatcccagcactttgggaggccgaggtgggtggatcatgaggtcaggagttcaagaccagcatggccaagatggtgaaaccctgtctgtactaaaaatacaaaaattagccgggcgtggtggcgagggcctgtaatcccagctactcgggaggctgaggcagagaattgcttgaacccgggaggcagaggttgcagtgagccaagatcacaccactgcacaccagcctgggggacagagcaagaccctgtctcaaaaaataaataaataaataaataaaaaagaagatgagtataaaggaacttggttccttccttatggatgtttagcttgtttaaaatgttgctatcacaagcaatgtaacatgaatgacattgtcatttcctgtgtaggccagtatgcctaggatacaatcccagaagtagaattggggtataagagtgtgggtttgtatatttttattagatagtgccaaattgttttacaagggtttctacaatcaacatttccactagaaatatatggaaatccctgtcttcctgcaacaattttggaggtttggatttttagagccaatctgataggtaaaaaattgtatcgctgtgcaatttaaacttattttttcttattttgaatgtgactggaatcttttcatatgtctaagagtcatttgcaattgctgtttcataactttctatttcttagcccatatattttctctgaccattgtctttttcttgttttccgggagcacttgacctattagaaacataaactctttgcagagtaatttatagataaaaattatttttccagtttatcatttgtcttttgattttacttgcagggttctttttccactgagcattttgaaatatttttgtagttgaatttatttcttctttatttttcctttctctctttctttcttttagagtttctggattttgagacattgtactgtattggtcaggataggtgaggttatgctattcctagctcatgtggttgttggcagaattcaattccttgcagctataggactgacatccctgttttcttgttagttgtcagcctggggctaatatgaattcccagaggaccatgaaattccctaccatctttcttttgattaccttaaaaccaactgatcagtgactttaattacatctgggaaattcttttactttagccatataatgtaatccaatcatgggttgacattccatcatattaacaggttccctctatactcaaggggagggattataccaagaatcttgggagctatcttaaaatattgactatcacagatcttcttgaaatttctcatcttctggtttgcatgtttattaagtcatcagattcctctttttttttttttttttttttttttttttgagacagagtctccctctgtcgcccaggctggagtgcagtggtgcgatctcagctcactgcaagctccgcctcctgggttcacgccattctcctgcctcagcctcccgagtagctgggactacaggcgcccaccaccacgctcggctaatttttttgtatttttagtagagatggggtttcaccgtgctagccaggatggtctcaatctcctgaccttgtgatccacctaccttggcctcccaaagtgctgggattacaggcttgagctaccgcgcccggcccaagtcatcagattcttaaagcaggtttataatgtattttaatatctgataggaccagctctcttgttgcaattcactggcttatatttatttgataaaatttccatatgggttttagaataaacttaccttgttcaaaaacccctttagagaattttataagcatcatgataagatatacatgttaacttatggaggagtggcatgtaagtgatggagaggtttccttttcaataaaatattgaatttccatttactcagactcctttggtttcaattaatagctttttaatttttttcttattatggttcttatgttttatttgttttgagatattttatctttttgttttgattacatgtggaatattttactaatatatcctataggtattattattttcttaaaagcaagctactgaattcagcatattcattatatacagtaatttttcagttcattctcttggattttctacttatacaattctaactgctgtaaatagtgacaattgttcctcctccttaatttttttgtacatccaatttctttcattttctaactgactgctactaaaatataattttaaagaatactggtgactggggatattgttttcttcttctcaccctagtgggaatacctgcaaggtttgacattaaccatgaagctattctaggctgagagagatatatttatctgggaaaagctagtatccatctgttactgttttattgattttttaaaaataaataattattgttgaactatgccaaatgtattttaaagcatcagttgagatgattacctaatattccttcttgaacttattaatatgactttatataaatagatctttgattattgaactatgcttggattatttgtattaacacttgatcatgatgtattattctttttacatgctgctgcattcagtttgctgatactttatatggggctttcacattacaattattaggtaatattggtgtataatagatcttgatcaggtactggaacgactattaataaaatatttttaaactaattcaaaaagtgttcttttatagtctaacactgtttgaataatatgataatctactttaaaagtctggcagaattcggccgagtgcggtggctcacgcctgtaattccagcactttgggaggccgaggcgggcggatcacgaggtcaggagatccagaccatcctggctaatacggtgaaacccgtctctactaaaaatacaaaaaaaattagccaggcgtggtggtggtcgtctgtagtcccagctaatcgggaggctgaggcaggagaatggcgtgaacccaagaggcagagctttcagtgagccgagatcgcgccactgcactccagcctgggcgacagagtgagactccgtcttaaaaaaaaaaaaaaaaaaaaaaaaaaaaaaaaagtctggcagaattcttccatggacacattccatcctattgctttttttgatgggacagggaagggttctttgacaacttcatatattttgtctgtttagattttgaatcttcccttagtgagttttggtaaattgtgtttttctagactattattcacttcatcaagctgtagctctatgaagttttgatatccagtaccagtctttaaaatacttgattttaatttgcaatttcctctgacataaagttacaaacttaattttttaaattcctagttgtcttctcggttagtcattaatttcttattttatcactttttttgaagaatactctgtgcattttcatatgttttgggtgctattgtcaatttttgttaatatccgataggcacataaaaattgtactctctattaaagggcaaatgttttatacacacacatatatacataatgataaacatataggtgtggtatgtgacatatctatatatgtcaatatgatctatcttattatttattcttttccatatttttaagtccttttattcacctgtgtaattatctgtgagagataagttaaaatcgctcattaaggaagaggagaaaattaacttggttctttcctgttcaaactcatgtttacttttatgattaagagacagaatttgacatgaagtcactggttcatatttttttcattgtgtatatcgtaggttgttacattatgtggagaaatccaagattagtatgatattttcctttttaaaaattcggaaagatatattttgggcaatgaggccaaaattatcaagtcatttaaaaattccaagactttaccaggatgtttcacagtgttgactatttgaaccagtttcctcaagcactaaaacattttcaattttgagtcatcttccttatttttcaacattttcttattaaaatatctgtaatatttattaggttggtgcaaaagtaattgcaggttttgccatgggccatttttccctccaatttcatcttttttttttcctgtcatttaaaaaaatcttctattttaattattttccctgaattttgccagctaatatttagatggcatctctggatggtttcactatttttttcacatttttttttacatttatgctgtgtaggtttttttctttataaatgttattacttcgttaatttattatgaattcttagctaaacatttggatacttttgctttatatcagtatttctcacttgtgagtgatctacatcaaatgataaattccaatgctatttttgatattttttcttaaaatattataaattctacttagtttgagggctacttcctcaaaatctcatctcttattccaaacaagaagtatagtttttgaactccgagttggccccttatcttcaagaaggcattgatttattgattgattgactgattgagacagagtctccctctgtcgcccaggctgaatttgggatgacaggcacacaccaccatgcctggctaagtattgtatttttagttaagaggcagggttccaccatgttggccaggctgatctcaaactcttcacctcaagtgctctgcctgccttgacctctcaaagtgctgggattacaggcatgagccaccatgcccagccagaaggccatttttgatggggctctctgagatttttctgcttctgggctctcttgtaatatcccgtatggcttctacttgattcagctatttttggaagcccttactgatatttttgaatatgcagattggaattgtcacctaatgtccctgaaaatggattttgtgtatattaacattgtttgtgctgcatctttatgattaccagaaaaattatagggaaaaactagacatatgcagccatgtttataccaatattcctcctgttttttagttcaagtattaatatgtaactctcagaagctgtattttattaggatctttcctgaatgttccacttgctctgattttctctggctgcagggcttctcacatgtgctaggattttcttttctcagctctctgggactcaggctgagctccaccgtaccttaagctagagccgtgcggtgggtggcaggaagtgctgtggtttcctccacctgatatagtgaaagcagcgtgggttctctactaaggagccaggagaagcctctgttttccttctcttccagaggtttcagcctaaggtataaacaagacttatcactggtttatctctccctcaactgtttggaagctactgaaatcaggtatactcatatggaatgataccatcatttttcttcttgggatccatactttaatgcaagacaggtcttgccaatatccactactattgccctccccttggaattctccatcattaattcctaagatcccgtcaagctctgaatagagaagctttcgggactgaaggagagcacagatgtatttaagccacgatcgcccattctccctcctaattttgcctatgaatgggttttatacaaattgttatgagattgaagaactagtgaaaaattaattggtactagtttttaacacacttctctatacttataaacttccaggggtgaaatttgaaaggaaaatatttgttctgccacttgtagtatttcaaagtcttgcagtattttgaagtctcctagttacattgagggtgattatacttcattttacaaattgctttgcattacaaaaaaaaaaaaataggtttacagtctcttaagaagcccttcactgattggctaatggtttctgatggtctgtagggtctaaatttgagcatctgggagaataccactttctctatccaagctgcctagctgcagggaaaagagggtagacagtagcctgacttccagggaaatcatctgtattgcaggttagggccaaagtaggtcagtaagagtagggaggctaaaaaattgactgaaacaaagaggtgagtagcaagcaattattaggagcaaaaacaaagtcctggaatcacagtgtcggggaggtaaggatccagggtgaaggtgtgagcaggtaaattggaaggtgttctaagccaacatgtaaactcagcatctgccaatgcaatttctcccaatactgtccttccttgaatgtttgttagcttattattttaatggcaacatcagcttcaacctctccttgtctcttaacccacttaaacaatatgtggccattctatctccaaattatttccccaaccacactccccttcctacttttgctgtaacttccttttccatcctccattatgtctcctggaaaattgccgtcattcccttaactggtttcttcagaagcctccagtctctccctcccatccatccttctcaatgctgtcagagtaatcttttcatgtaagagtgacctccaattgtaagcgcgacattgctgcaatatcatttatctccatcattattgcagtttgtattttgcgattggaaggatggggcaggcaccaaaaaggtgatgtgacttgtgctgtattttccgagtaagtccaagaggtgaattatggatttttctaccaggctgactcaggttgaatgctgttcatttctgggtttgtgtctattatcctgcaaataacgaatacccctaaaatgttagtgtgcaattatgccattgggatagaataattctctacaacataaaacagtttttatacaactatgaaagtagtctggagatttcaactttcattcaaacaaaattgaaagaaaatgaataacgttgagacaactgagcacaaaagaataatatcgtattttccaaaatatacacatcaaccactttaggctattgtatgtgaaagggccgtaagggtagctgggtagaatatgcccaaaatttcttccaatcatttttttttcattgcgaaataccgtaagaactctatccagggagggcgactacatttttggcagggacaagatacaaaaactagagagatagttgttcattctttgagcagcaataaaaaattcagtcttgctctctctcttcccctctcttccctctctcctctctccctcattctactcccttagaatacttgtaagatgtcatatgtaggtaaaaggaatacatcatcagacaagtatgagcactggaaattagccaatgtagccaaacttggggaaatttatgtgttgcttactctaagattgaggcaaatgagagtgacagttctttccagctcctcccctgattactgatgaggtattactctctgagttgctctaagattgagccaaatgagagtgacagttctttccggctcctcccctggttactgatgaggtattactctctgagttgctctaagattgagccaaatgagagtgacagttctttctggctcctccgctggttactgataaggtattactctctgagttgcctagtagtaaagaggaagtgcggtcatctagcatcattcaggaggtgaatttataatggttcctcattgtttaaagcaatcttttatttctattaaatgtctatacttttatctaaaataatcatctttaaataactgagatcatacaacattccctaagtgctcctgtgtagcacaatgttatgacctcttctcttgtcttcttctcttctccacctgtatagagatagtgacaaatcaagtcaatatctgtgaaacaaatgttctcatgattggtaaagcactcactggctgtgctgaaatctgggtatatttatttttcattatagctaaataaaataaaaaaccgaatagcaacaacaacaacaacaaactcacaaaaatctggaagataggaatgttcagtgtggcaggtaggatcaggaaagcagatgagtaagtgtgctcttgctgaccgatatttaccaagcactttccaggagccagatagtaggtacactccctgcattaactcatttaatactcacaccaaatctatgaaggagggtttactattgccaccactcccccagtttcttatagacaaagaaactgaggcatagagaggttaatcattttgcccacaatcattcaagtagtaaatggtagacctgacgttcatttcctgtgatcttgatcctctccataagatgaactcagtcttatagatgctttttcaaccacctcatcgtgattacagaacattctggctctattactttgaacaaattattcaacctctctgccaactcgggacaataagacatatatgacacatgatcttcaaatgtgtgaagattcagtgatgtaacaggtataaagtgttcagcacagaagcctggtgcaggccaggcactcactaaatattggttgtcttttagagtgattttcttctacctgaatactcctaagcaagggtattttcttctttattttatatcagtgatagttaacagagggcatctcacacaggaaacgatcaaaagaaaggaagaattagagggaaggcttgatttacataagtgttggaagctggcgtttctgaagaggccattgaaggcatactgtcatatctgagtctataatgaagaccagaattttagcaaataacttgagaaagtgtccaagcaagcagcaaaacttatccctagaaaaactcatatataaaaaggttggcagaaaatctgaaatgccatcaagcaggagataaagatttggtacatttccatggtccattttcaatctttttacctgtatcttctacctcaccagctcctagctcctgccgtgaaagtttgggcctgaaaggcaagaatgcaatgtgattgtattcacaccaaattgtaaatgttgggcttctgttctttccttagatttgttttgattttgtacttggattagggggtattgcaagatggcacctagtgtatgaaagctattaattgccaagtaggggcaaaagatcaaaaacgaaaaagaaaaattgtagtaaaaaatctctttagcaagagagcttagataaattacaactcccttagagctttcttttttttttctatttgtacagcattagtaatttttgctcaatcaaaagactatgctgaataaatggtgttcatgaaaatggattgataattgaaaatggattgataattaattgttggctgtcaacggtggctcatgcctgtaattccagcactttgggaggtcaaggcagacggatcgcttgagctcagtagtttaagaccagcctggccaacatggtgaaaccccttctctaccaaaaatactaaaaattagcaggatgtggtggtgcacacctgtagtcccagttacttgggaggctgaggtgggacgattccttgagctatagaggcagaggttgcagtgaaccgaggttgcgccactgcactctacctgacagagcgagaccctgtctcaaaaaaacaaaaaaattagctgggcatggtggtgtgtgctggtaatcccagctacctaggaggctgaggcaagagaatcgcttgaacccaggaggcagaggttgcagggagccgagatagtgtcactgcactccagcctcggtgacagagcaggactccatctcaaaaaaataaataaatacaaataaaaaataaataaataaaataaaaataaataaatggaattgttgcgattatcattatgattattatgtcatcttttagttgagccaatcctgaatgtatttaatgtattagtcctatgctttaaggcagggcttggcttgtgctgcctggacaccaaaggtctcagatgccatctcctgaaatgaccctacccaggacaccaggaaacagctgcatggccagtcctgacctctcaaaaagcaaccgtagcccataaatagcctgatgatggatgtgggaatgagctgggacctcattcccaggtcagattctatgtgaatatgggttctggtttccaactatgtcagggccagcagatatgagtttgtgtactacaagtcaacatttgggaggcctttgtagagctgactccacatccattttatcctctctggcgattgaaggcttgggggaaaacagaagaatggctaaatgagcagtgctaagtcttgtatgagtaagatggaacagttcaagaaagacaattctatgtgcttgagcatcatctctttgattctgacccattttttccactctcctgttttaacctgtcttctattaaaaaagaagtgaattaaactgttttgaaatatgagctctgctacttactaaccagctatatagccttgggcaagttacttgacttctcatttagttcatgggtaaagtagaggaggatcataatagaacctactcaggcttctaaggagaaacaagataacctagcaaagtcctcagcacagattaaataataaatattacctcttgtgaatttttcatttgtaaggaagcattttatcccctattttctctcattagcttgacaacagaactttaatccacatgagttgatgccctataatagaggagttgtgggttgatgttattttaaaattctaaccacatttcctcatcttttgatgacacttcaaacttttcattcattagcttggtattgtcaaggcttctaaaattgccagatgtcaggttttaatttgcagggaccccggagatcatctcatccaaccctctcagttttatagtgggaaattaatttaaaatttaaaaaaaaaatgactgacccatttgtttccagcattctgtaactgcattaaaaaataaataaataggccaggcacagtggctcacgtctgtaatcccagcactttgggaggccgaggcaggtggatcacgaggtcaggagatcgagaccatcctggctagcatggtgaaaccccgtctctactaaaaatatttaaaaaattagccgggcatggtggcgggcgcctgtaatctcagctactccagaggctgaggcaggagaatggcgtgaactggggaggcagagctttcagtgagctgagatctcgccactgcactccagcctgggtgacagagcgagagtccgtctcaaaacaaataaacaaaaaaacaataaatagcaataaaagagttcacgggaggtaagctgccccaggttctgtcccaggtcctttggttctgtccaaaatttatgccattggttatgtcactcttaactctctaggacctcattttttacactataaactgataaatttgacaatctctagctgaatgtatatgtgtgtgtctatttacctgtatatttacctgaattatggtaataaatatagatacagatttttgttataccacccattatcagcataatgcaatttccatactgtatttatggtccatggttaaaatgatgtgtatacacatgtgatgttttaatatattagagctcatttcaaagaaaggcagtgcaaggtctgttattagcaatgtgtggggtcttttaaagtcaacacctggtgaaaatcctcactgcccggagtacttttgaaactccttttctgagccctttgtggagcctgaggcacactgttctcatgctgcttattgaacagcagagctgatctttgcctttcaggaacgatttcagttttcaaaatagcctaaagtaaaataagcatagcaatcaatatgggcaaaactacatttagtcaaaggccagctgtgtctagcagataaaacgacatgatcttcttgtgtagatcttacactgaagctggcaggaaattagaaggcagtggctgctcctgtgtgaatagtgcctccaaaggtgccgtctttgaaggatgacattactttgggaacatgggtgcattctgctaaaactgtatgattattatcttatgatcgtatctctgtgtcaaagacaacagaatcatatacgtttgttgttttttttttttttttgagacggagtctcactctgtcgccgaggctggagtgcagtggcaccgtgtcggctcgctgcaacctccgtctcctgggttcaagcaattctcctgcctcagcctcccaagtaactgggattacaggtgtccaccaccacacccggctagtttttatatttttagtagagacagggtttcaccatgtggccaggctggtcttgaacttctgaccttagcctcccaaagtactgggattacaggtgggagccactgcgcccggcccatatatgtgatttttaccatttgtccatagtcgcaataggaaggatgagggagatttttggcctagcataattattctaaggaaattcagttctgaccacaagcaatggtgttgttagtgtgagaacctggtgctgtgactggggcattccctcagagacttctacttgtgccttctctctcctatgtaggagatctcaacccccgcgaaaagagtgcattgcatttttactttgaagaagtttgagaaagaattacttacaacattattattaagaacttagaagaatattcaaaacactcctataactaacgtaagattatagcaatcaatgtgctggaatacaaggacactctggtgttgggaacgactgcattaacaatcataaattaagtatacaatttgttttgtcccccagtgaattctatgaggagatatactttaaagccagtcctgttgaaaaccctgatgtcttatgaaaaaaagtagaaaattgaaagaacactgacctggatttcaaattcagtagctgctgcttttatttgaacaaatatttttgcctacggacccttttttccccctcctggtaaaatgaaggggtgggaccagaaaccttctttaagtgacagtccactgtggcccgcattacacataaggccttgctcctggccgcacttctgtcatttgctccattttgtctgacagaaacgggctaagatttcatttcataaaacaaaacaaaaagtgtttctacttctaaaaaggaaaaagttgaaaatctcttcccaagttcccttatgtccttgttttcctgtagagaaggtggtgctttcatctttcctaggccgagctgtaggttcaattttctataatttcagaaaagcagagctgggtttacctatggagcaagagaatcttggcaggaggaaaccatggagcagattccaggcttcttactcagcactgggaggcgaagaacttgtcacccttgagaccctctcctcttcagtctagctcatgtgttcagcgtgcaggtcatttgtgccaattagcttacctttccaatcagctggttgtgacctgtcattgttgccagctcccaaaattggaaggttttcttcctaaaatatcagtcctatgctttccagaaaggtatagaatgtgcagtgtcttcacagcctgtagaatgtgtaatccctcaagtgagattacagaagacagagatttcaaattcaatatgtctaaggtagaatagatttttttttttttttgctgtaacaggcatgaatttcgtgtttcaatgatacaacagtaatctagtttgccaagctaaagatttggacactattttattttcctcatctaaatgtcagatccaggaagaaaatgaatttttttctctttagtcctgtcctcaatacctagaaaggtatttggcacattactggaatgacatatttggtgagttaatgaataaattaatattcttctctttaggtcatattctacatccagtcttcaagaattgtctatgtagtttcaggtcttgtttgcaaacccttctatcctttcagtctgtgctgctgctcactgattgttctctttcttacctcttccttggattatcacaattttctcctaagtcacctactttcagctgcttctggccaataggctctccatactgcttcaagagtgctggatgaaacatagcatatgatcatgtttgtggcatcacaggtggtttatgttcttagagctgtcgatcaagaaaaataatgagacaagtctcaatcattttaggaagaggtttatttgccaaagttaaggacggatcctgggagatgggtctgtgcctttctctgaagatgattttgagggctccaaatttaaagaggaaagggcaggatattgagaagtagacaatttcatgtaagaggaaggcagggaaaaaatagtcatctgtgcctttgtctggctcagtgaatctacatttttttttttttacataagatgatatagacaaatgaggcagagtaaaaattcagggaatctgcattttacataagataacatagacaaaatggggcaggggaacaacgagatatgcctttgtgtctggtgggcagggggtgatagtacctgtaaagataagctatcaatttacattgctatggcaaaaatttaacagaaacaccttaaatgatcttgcagctcactaggaatttcctcatgggcaaaatttgggtggggtgggggcataggggggcatgtagctttcatcttgtagccatcttatttaggaaccaaaggtggaggcaggtttgtgtgacccagttcccagcttgacccttcccattggcttaatgagtttggggtcccaagatttaatttcctttcacagagtatattttccacattccctgtgatgtatgtatgtaaacaccatacacagaggaaagaaaagaggtttaagattaccgtgtttcactcctctatgaaattcttagtcacatcccgtgatccttaatttataatccaaactcaacagggcatgcaagtttcttcaggacccttctcgtttgcatctgacaacttttgagtctatattctggccatagtgactgtctcgtggccctcctcatgcatgacttgtggtccacacaactttcatccctttgcaaatgctgctctctggacacagagtctttcagacagatccactgctctttgaagactcagctcatatgtcaccactcttctcactgttgcctctgctcagcccccacggcacagaacatgctgtattgtagcaaaatcaggcctctttacctcacaaatagaaagtgaacatcttgaaagcaagggcaatatctagtttgtctttcaactcctgctttcagttgagtggcagctcaataaatatttgccgaatgagtgaaaaattcacccagcaaccacattatgcctcttgggaaaagtaactcctaaagagtgtctttataaataataaataccaggcttttccttgtgcagaaaaaacagacctcccaaacatgtttattttggtctaatacacagaagtgtatattggtgtgagaacaaaaacccaccaaatattgttataggaaacatatcttactgcaacccagctgcatgctctgtgactttaaaatacatgtttaaaatgctttgcaaaattgcagcatctgaaagagaagtacaggatagtggtgcacacagagctggccctgcagagctggctgctgtggggagtccccttggttacatcttcccatctgtacagacagcagcaggtggaacctgagctgttccatatgcggattagtcaatcgctttttctaaaggttccaagaggcaagcttacattttgtcttcagatctttatatgaaaataccactgtggataatgaggctgttgtatgcataatttaactttcggaagcctaaattccgccgaaaggcaaattggtacctagaggcatgcaatttgcatggggatttcaagccctcctcctatctattgtccctggcatggtgttgcttttcttctaaattattttcccttgttctttgaatgcctaattctgagattgtaaccagattaccatgggctccatatttaatagtggtttcagaaacctgctgagcctgctttgaccatttctgggagcataagttggggtttggcaaacctctgccagcacccagaggcagtctttctaatgaatctgctccttagcctgcagcccacctgcctggagagggttaggaccagctgagcctgcagctgcccagagtgggaggagctgatggagtcctgtgtggctgacttcacagctcaatctgtcaatccggttggggacagatggttagagaactgtctgtctgaattgcctcagaaagaatttggtttcttggctgcatcttcaagtcatggtccactttcctttctgctctggactggagaatgtggctgtgttgggaagggtactaactctacttttcaaagcctttcagagtaaggatgtgtgtaagtaaatcaagggctcaggagaactaactgctgattgtcttctgatatttcgtgtgtcatctaataggcaatgtcgattttgcatgcagtgcacaggagcatacctgtcaataaattctaactgctcagaaatgatttcttctgagtagcatgtttgtattttatgaaggtaagccatgaagacccaaagatgtgccaatatgtttactgtaaccatattggataattttgacatatggtgaccagggcagtttacagatgactgagaagttctttcctgatgcttagtaaatacctaagtcatttgaaatgccaactagaaaccaaagaggaaaagagaattggtgtggaagaggagaaaaagaaaagaagaaaagcgagacagagaaaagccattttacctaaaattggaggtctatttcagatcaatttttagatcaagagatctaaatctgggtcagaactcactgaatacttagctgggtgaaattgaccaagtcactccttcattccttaaaatgaaggcattggacttaataatttctggaggtctccttgaaatctaatattcagaaaatattttatttgtcctctaaattaggttattgtagctatttcaaagatgactggggtatgtacactagccagaaacagggtagcaggtctggggtagagacagaggtccaagttccctgtgatatggacaacacataaggaaatactgcgtagaagagagtggttccccagcaaagtccccaaccccaagcctagaaacctgtggccttaaatgggagctggtattcctgttttcacgcccaaatgttgccttttccaagaccaatctggcttaccatatctgctatactttgctcatataaaccccaagctccacgagcagaagagcacgagagctccatcacctttccagctcctcatccattctgctgggagtcacctccatccagcaataaaatcccccgcatttaccatccttcagtttatccatgtcacctgattctttctggatgccagacaaggacccaggtaccaagaggtcactgagctggttaacacttaagctgtctgcagatagcagagctaaaatagcactgtaacatgccccctggggcgtcagtggttgcaggcacccacccctagatgctaccttggggctggagcccaaaagcatttgccctggctcctgcctgtctgtgtgctccccctccagtaaagggtttgagcgcatggtggctgaacaggtaagccacacccctgtcacacatcctgtggcaggggtgggggtgggggtcagggaactctcctgtttcacctgcagccccccaaataattatcattctttgagttcttacaatgtaccaaaacctgcgttgagcaccttaaatacattaccttgattattccttaaaaccacctgcgacgtgattattgtttcccttcttgtatgtctgagaagataatgacttaaactgcctcaaatcccttcatccagaaatgggatgtcctgcattttgaatctctgctttattctacctctataaatgtctaatttgcctaatagtgatcccctggttttgggttttgacaagataggggcccacctaccatttcctcggctattctatagttgtatgttataaggagaccttaaaataaagatatgatttgtcttgctaggagcaaagcatgtatgcatagctcatataagaacacatttctatggagataacattttgaaccaaagtggctttaaaaggcagcagagatgtgtatatttcctgaaggcatagaacctttttctccctctagttaacatggcccttcttttcttaagactgacagttgtattcttgttgggcagtcactagaatttgttctgttgccagacctcctggggcatcaaagtgctgtctgaattagagaataatggcatgatgaggtcaatgacagctctgaaaatgacatgttgccatagtggtaagaaaatttcaaaaatataaagaactccattatcttatgatattttattagtatctattctcctggcatagtacagtttttattcttctaggaatgggttgaataagttgagtccactcttatttttatgatctaatgcatagaggcaacatcaaaatacgaatgccttgcaaaagattgcctatgttgtgaaaatgagaagatgtagttgttaaatgcccataataagtcaggcattgtaataatttataagagtggataaaaatactagaattaaaatttaggggtttttaaaaattcctttttcttcacatctgaagtgtgatattgatctggatgtgtggttgactccaggatggtgaagaatatgtaagtagggattgtgataaataaagttcaaataatatgagattaaaaaaatctttatagaaaaggatcagggagatttgaatacaagagttatattgtttagttagttctagctttccaaagattttcagtagattttattaaaaggattatgttccatattagctttttttttttaaaattttgctttgcagacatttaaagtgatcctgatattcaatggcacatataaccttcattgatttgctttccagctctttgtgactttacaaattcaatgcatacaggtaaagtgtaatcaagttattaatctttgagaatctttatgtactacttataacagaatcagttcttgtgactcagtaaggaaggcaaacattttcatgaattgcagtctgtagaggagaagagtagtgttgattgtatttctttacttttatatcacagagttatattacacccagtcatttacatttgatgctatttgatatgataacatttgctatgtgaacagaattgtagaaatcaaaaatcatttaaaaagagtctcttcctcccagtcctagaataaaacagttccgtctggcgtactgttattcagagccttctgatgaatactatgttactaacgggtaagaataaggagaagaaaaaggaaaaaggagaaaaggtaccatttctgcataattgaaataaaataggaattactgtgggaagtatttcctggatgttccacaagaatttattttactttcagtctctaaattatgacagtgttgcttataacctttaacagttggattccagatgtcctccatttaacactgttcatccaaacatgtgtacacaattggcatatctactttttatcatgctgtgataaacatcatgtatttcaggtactgattcttttttatacatcaaaactgcttcagatcagcagaactcagacacagtgtatgctgggacctcaatagtgtcagccagggtggggcttagtcatggttcaaagaaaaataaattgaaataatcgtatgtttttcttaaaatatgttaatattgcatgtaaaatcttcacatacgtgggataaacctcacttggccatgacatattatcctttttttttttttttggattaagttcactaaaattgtgttaagattttttgcatctatgtttatgaagaacacttgtatgtaatattcttgtagtgtctttggttttggtgttggaggaatgttggcctaataaaataatttgggactgttccctcctcttaaatattctgaaagagttttacagaattggtgtttttttaaattacatttatggtagagttgccgagtaaagtcatctgggattggagttatctctgtgggaagattttcaactacagtttactgatatagatagttcaataattatatataggaaaattccagttatctatttttgaaaaaccttctatggtttgatgttttaagtattatttattatttatttatttatgagacggagtttcactctggttgcccaggctggagtgcaatggtgcgatctcggctcactgcaacctccacctcgcaggttcaagctattctctcgccttagcctcctgagtagcttggattacaggcgcctgtgaccacacccagctaatttttgtattttttgtagagacggggtttcaccatgttggccaggctggtgtctaactcctgacctcaggtgatacacctgcctcggcttcccagggtgctgggattacaggcgtgagccaccgtgcctggccaagtaatttttctgtttcatcaaagtgtttgttggtggtgacataaatttgttccatataatttcttatttttaaaaatacctctacagtctgtagtgctgtcatttctctcatttctgttatcgataatttgtgtctacttttttccctaccctcgtcactcttgatagaatcaattttattaatgttctcaaaggatcaagtttttatttcactagtttttctctattgattttcatttttccattttaaaaaatttctgacttcattattacttttttccttctgcttattttgtgtttcatttgattttccttgtttttcttttttaatatggaaaataagattattaacatgaggtgtttttaaaattctaatataggttaccagtgctataaatttcccaccaaagtcttacttttgctaattcctacaaatattgatatgctctgtttttattttcagtttaatatactttctaattacttttatattattcctttctccattggttaattagaagtatgttagttccaaatattttgacatttccctgatatcatttacttattgatctctaacttaattccactgtgttcagagcacatgcattgtatgagttgaatcattttaaatatattgaaacttgtttaatgaacccgaatatgatctatcctagtaaatgtggcatgcacactagaaaagaatatttatctgctgttgttggatggagtgtactataactgaattttttcaagttggttgacttttgttcaagttttctatatctccactgatttgctatcttcttgactgtcaactaccaagagataagggttaaaatagcagattataatggtggatttgtccatttctcccttgcagttctattgatttttgcttcatatattttgaagttctgtagtaagctgcatagatatttatcattgttatgcatccttggagtgtttacccatccctttatcattatgtagtatcattactcttttgttttctttcttccttttttttttggagacaggttttcacaccgttgcccaggctggagtgcagtggtgagatcatggttcactgcagcctcaatctcctgggctcaagagattctgccatgtcagcctcctgagtagctgagactgcaggcatgtgctactgtgcctggctaatttttttgtttgtttgtttttagtagagacaaggactcgctgtgttgcccaggctggtagtatttctctttattcctcaaattttggtgattataaagtctacttggtctgatgatagtgtaattactccagctttcttttgggtattgtttgtgtggtatatctgttttcatttatgcttttagcctgtttatatattttaaagtgggctttttgtaggcagcatataattgggtcttgctttttgatccaatatgataacgtttcctttttttttgcatttcctttgttgttttcttacctctatttctttgttttattattttcgtggttgctttatcattatttgatagttttagtatatacctctagctttcactgtcaagttgcaagtaatattacatcacttcatgtgtattataagaactctgcatagtacacttcacttctctctcccctcctcatctttatgctactgttatcaaacattgtatatacatatacataaacatatacatatataaataaacctcacaatactttgttactatttttgctataaacagttgattatatttggaatatttaaatgaaaagatactttatatttactcacataattgccatttcccatgctctgtatttctttgggtagatacatatttctggctgttaattttcttctgactgaaggatgtcctttacatttttttgtaatgcaactctgttactgctggattttctcagctgttgtagccctataaatggctttatttcacctctgtttttgaaagatacttttgttgagtaaagcattgtagattaacttttttgtttttgttcttccctttcagtttcttaaagatcagctctattgacatctctgttgcaaatgtttataagaattctactgttatcattacctttgttttctgtataatgcagctttttctgttggtcacttataagatttacaatttatcactggttttcaatttattgctgtaaaaagtttattatgatgtgcctttatatggttttcttcatccttcttatgcttggaatttgtcgagcttctcaactctatgggtttataattttcatgattttttttaattgactattatatttgaaaatagctttttgttctcatcttcttctggaactctacttctacatatgttatatgcctaatatatactttgaagtcgccccatacttcactgatgctcattattgtttttaacttcctatttttgatagtttctattgctatgtacccaagacccctaccatttcttctgcaatgtctaatgtgtcttccatcccatccagtgcatttgttatttcagactatatagttttcatctctcatttgttttccatttctcaagaatcactgtccttctttgccagaaatctaaagtcttagtccatgatactacattttggccaggactggaaatttctcatcacctttaatgtatgtaatctttgccaaatgaattaaattctctctcaattttcttttaaaaaattgtaattacaaattagctatgtcaaaaaaagattgtttaaaaaataaggtgatccagaaagacagcttagtatattctttgaagcatcttaattagtaaaggctagtatcattaaaattaggaagtgatgcttggagtcattttaggcattgatactttattctatgtgatcagttcattggaagaatgaccctgggctgagggaatgcatataggccatgtagtatgagaaacaaacaagaacaagaaccaaggagagtatttgattatttggatcctagaatcttagactctcatctcagaagcaagattaggataagaacaggacatgggactagatgcccagtccatggcctgagcatcagtggtaaaacaggagaaaactacaaggaccaggtggatgctgtcagcttgccactgtactactggacatggtaccagatttttctgtgtgaaaacctggctcagcagtagatggggctgagctttcagtgtggagataactgtgtctacaatcaagagagtctgagaaagacagggattaaaaatattatttcttgctttatctatctatcttattcatttacatgaatgtccttcactattgtaatgatcttaaaaacaatgaaaccccaaagagtttacttcagcggaggcagagatgtgaataaattatggaagcttagggaccctcatatcccccatctcaaaaaaatgatactgcagctatgactgcaaaccaaatgcgattgcctttctttgtgttcacatgatgcctgaaatttactagatatgtttcttctctcatgcagcctaacatatatgacttgtaaaccagcccatgatatgtcttagttaggtaaggctgccataccatagactgagtggcttaaacaacagaaatttctcacagttcctgaagctgaaagtccgagatcaaggtttggcaggtgtggtttctccagtggtctttttccttggcttgtagtcagctgcttctctctgagtcctctcatagcaattctctatccacataccctcccgtgtctcttcctcttaaaaacaccagacctatcatataagggacctcttcttaggatctcattaactttcattacctccttaaaggtcctgtctccaaaaacagtcacattgcggggttagggcttcaacttgtgaattttggcaagggttgtgggggggcacaatttcataacatagtatgaggaataggtgtttacacagaatttgtctcctgaacaaaacttctatatccttatattgcagaagccaacactctggctcagaggtttatggaaagaacatttgctagaaggagaagggccagtatcttcactggtattttggacaagggtcttgtttggatatttgttatgtgtgtgtcttcaaagtgtgagaccttcggccacatccctcagtggctgaagtagcattctggattaaggaatttttaaaattaaattaaagttttaaattaacacatgataatagtacatatttacagggtacataatgatgtttcgatactatgcaatgtgtagtgatcagaccaggataattagcatagccatcataattcatattttttactgattggttggccaacatctctccaattcatgaatctagaggaacgtggtttatggacctctgctcctgtggactctgttcaagtccgtaaatggtttgagcaaggattgctcaatttctgttaacctcaccatagtcagggtttggggacctgtaactgccttggagtgatttcaagatgctgggccatttccagtcatctcttattctcacagaaacctcctggcatgcctggcacatcttcactcaataaaaccatttaaataaatgattgagcaaagaacacctattcaagtgtccatgccagaggggaagatgtaggagcatactagaagttaatgagccaggaatttaaagttttaatgtgtttgtccctgaagtttgcctcatccatgcttatttttagaaagccatagattctgttgctggcactcatttctagtgctttttttattgctgatcagttttaaaaagtaaaagcaagttcatgccaactatatatttcagccattttctgcatcctttgcctgcctccaaagcagaggtatacaggggagtggagaataaagccactggacagccgagggccatgtagtcccagagacagctcttccaggagcatggaagaaaatattaactctttccacttgtactgagatatttttagagtggcttcttttctctttggcttgtgccagggtgctactttattgaggagctgtcaaactttttaaaaaagaattatttctatacaagaagagtttccttgattctatatccattgtgctcttttataaaaatctcacttgttctgggaacttactaattaatagttacattgcaagtttttttttcttttgcctcaattacctaaaataagggtaaatgagtgctaagtttttttgttttgttgtttgtttggtgggtttttccttcttggtttttttttttttttttttaaagaaaaaaaagaattactggaaattacatttcaggggcacatgcctagtttgggacagattgaaataagaagacatccaaaacaggggttatagagcacacaacatgtatttccaagtaaaaaagcaaggctgtttttagatcttttgtcatattgagtcattgtaaagaatgagactaaatttattggccacataggataatctgtcttattccttcaaagaaactgctcaggtacatgacatttctgtctccaaaccaaatgtctaatgtgcttttatcttggcaatgtcacttaaatccccttccaaatcttttcttatatgtcatcatgtaaaatagactcctggaaaccaaaatggctactcaggaaggccacgctctaggcagttcatcacaggaagctggagctctgtgcttctggtcctatgctccctgagctgctatagctatggaccatggctaccacccaagggtttcccccaaaccatacctagcctctgcggtctgcctgaggtaggaatttcttagtgtgcattgattctctttcttccactttcctgatgacatttcattacagcaaagaaaatttttggccataaagattttccatatatggatcttttccaaaatctgtgtctgtagttaggaacaacttaataagaaggctcagtgttggcaccatttttaagaatatttatttccctgggctaatattcttttaaaaatactgcttcttaagggaaatgatacctgtaaaagaaaaattagaagcttctgaataaatttgaagaggaaagtcatgaaaaattataattatataaactttacactattattgctcttttgctatattttccggtcatttttgctatatttacctgatttttatagtcatgattacataatatgtttttctctctatttgtttaacattgtattataatcaggtttataatcaggttaacagatgcttcataaacatcacctttgacaactgcatgaaattccactgtatgactccaaatgtaatttactgaactgttctattaatggaaatttatgcaattttaatatttctattcatatagatatatggcaatacagatatttgaacaacattttttttctgatttaggatgttttctttagacagattccatgtggaaatatgaggtcaaaaattagaaatatttttaaacctttgataaatagcgttttccatactgtttcctacctcgttgtaagtacaagtttgtccacctggcttcctaagttggtcaacataaatttgcaccaacttaacatctgaaatataataatatacactgaggttcttagcataatttgtgtttcttttaaattggcattgctgatgacattaaccagtgtgactggggaatgattctgttgtccactgatccatttaatgtctcagttctggccatctagtggtctagtctgtgttttctactgaacaacatattgagcttttctctgctgcttcctggctttcatatttactgcagagaaatctcattgtctgcaatgattggacttttagaatagaatcttagtcatctgtattctacggcatgaaaactaggcccacactatttactactgacctgaggactcagctctgcctgcatgtagacctggaaaaacaccttctgcctgtgctcagaatacctgctggacctggtcactctctacccatgctcttttcctcaatgctttccttcctttcacctgttgtcttttcatcttctctctttttattcttggtctggcactcgtgcaagtagaagtgatttgatagcttcctcaggcttttcataaaaagggaccatttccatgcaagtgctatttttaccagtctcagaattgtgtaaaaggctttggttctgtgatattttctggaccacactataaaaattccctgatgctatagacccatgggttttactttaactcagtatttcctaaactgtgcttctgtggaatttcagttcaatttcaatgggagccaggaactaaggttcccatggtcaaataaactgcaaactgtgcttcctaaatggtcttcttgaagatttgcagttcatgttatcatatctaatggtttggagacatcagaaggaaaaaaaaattatgttttaacttggtcactccccactgaggaactattttttttctctttttattttttatggctatacctagagtcatttttccttaaaacccatctggaaaaagctggtttgaccatgcaacctgtttattaaagtggaccatggttttacatcaaggggaagatgtgacaaaaaataaacattttccagttttggagctggactgtgcacacatttctgttcagcagtattagaaccccttcaacatttggaaattataatgtttctgcagatgggaacaagctggatgccaaggagtgtgcatgagcgagagcagaggcccagcctgtgagctccactctgctctgctggcagtgatccagtgactacctaacagagagaagtggatagctttatgggcaattgtttgcccactggttgaaatgcttgggttggatttatcggaaccatggtcacataaagttgtctgtcacccaaagggaatcataaagatgccttgagtaccagagaaggatcattgatttctttggagccatagtgttcagcctctcacagctggggaactgctttgctgtgaaatagaatttcagttggatacaaaattaatcagttttcacagttcaaaattttgactaagacactgtgtcagtgtgtttggtacatgctgtgtttgagcctggaagcctacgcctcacatttgtgtagcatcgtgacaccaccaactgcctgttgatgtcatggggaaccagggtaatggggagcggacagtttctcctctgccactctagctctttctcccagcttgaatacagggctgacctttcacaaactaacacatctagaagggaccttagtgactattaatccaacactgaccaggggaagaaatccttttgcaacacccatgatcagccgctgacccaacctgtgcttgcatacttgtaataatgggggatccaccaccctacatggcagccctatggttagattttgaatgataactaggctttggtgaaattcctgtttcgtgaataaatcaaaaagaaggcaaattccatgttgtctcatctctctactggcatgagatcaatatcaaggagacaatcaatcacttatctttcatgtctctgatgtgatccatttgctatattttggtctcaaatgcttgggaagacagtagatagagaaagaaactgatacttatgatccaaaatgatctgccaaatccaatctcttgaggcaattaaattagaaggatatataggtcttcccaagaaacagaactaggcaaacataggcatttatatttggtgcaatatcctcaccctaacaaaaaaagaatgtttttctacttatatagctgatcacacagaaaggatcaacaatcgagtttttgaacataatttttcatttctcaaaaccctacttgcataaggaaaacagtctgttcacaaagagggtttcagttttgcagtgaagtgtaatgggaagaatatattcagatatgtttattaatcaagatctacccctgtctttttattctatattcgtttaggtggtccgtaacaatggggaagaaaagatgagcaagttatggcccttgtccttaaggagctcaggatctccccagtgggctgcaggaatggcaaatacccacaaaatagccgccacacaaggcagagagtgatacgtgttctactaagaatagcagtaaaatgctgaggaatcagagagatcaaggttaatgccaggtggaagactggggaaaagtacacagctgaattgactctgagttgcatgtgggaaaatggatgagatttcaaaaggcagagattaaagagttactgctacatggaggcattttcctagaatgtccctcagtataggaggcaggggctttcaaaactctgtattcatcattttctatagacatttttccttgtagtatgtcttgtcactgtatccatagctaaagttttggagatttgtatgcttatatcattgatgggattgttttaaataaatgtcttataatttagcaattttagttcctggagtcttttcacacttactgagaaatctacaaggtactcttcttggttcataggtaggtacccattgcattgacttttaattttgggtggagtctgagtgtccttattctcttttctcatggaaaaatgtcgtgccctggccagggaggaggaaaagaaaaacagcatactgctggatggctccaatctttctgtagtattgaagacagtgggagaaggaaagagagaaaaagggatgggagccgggggcggtgactcacgcctgtaatcccagcactttgggaggctgaggcgggcggatcacgaggtcaggagatggagaccacggtgaaaccccgtctctactaaaataattagctgggcctggtggcgggcgcctgtagtcccagctactcaggaggctgaggcaggagaatggcgtgaacccggaaggcggagcttgcagtgagcccagatggcatggcgtctcaaaaaaaaaaaaaaaaaaagaaaagaaaaagggatgggcctttcaatctggtgagtgcaagcaagagtcttgccatggtcagggatgtgtaaataagggcagctttctctcaatatggacattctcaatggacatttacattcattcattacgttttcctcgaagcatggaaggagtacatgctgtgtatcaggagttgccttttcaaagctcacagtctggtgaagggaaaggaaacatgtaaactggcatttgcaatgcaatatgataagggctatgacaaaaggaatgtggaattctgtgtctttgagggcagataagagagactgcaaataatagctctagaagacaatgtctgagccaagcaagaattaggtgagcaaaaagatgggcacctttttaaaaattatgggcatttagtgagtgattttataaagaaaatagcacattcattcatcttaattaagtttactttgcagttaattacgctgagtgaccttggggatatataagtatttgatacagacttaatatgaggtggatgcaaatatcactgataggtgagtgtgtgctgcaaaacgatacagagtccatctgtgtttgagtaatgataattatcaaatctcattggaagtttttcagttattgaatggaataatatgcagttcttctcttaataaaattaattcaagcatactttatattaaacaatatattttggaagaacactaccaacaaatttaccaaaacaaaaaaaataatgtcacagctctcaggaggtgccagcatttattgattacacactacatgttgttacatacattcatttatataattctcattttaaaaaatcttagctgatattgttggctactgcttacatttcatcctccgtggcctttacttcaactgaatttcagttttatgccaacaatcagcccactgtccttcacatggccgtgcatttgcttcatgaagctactcaggggaatgccaatattcagactgagaatgcttaagaggtgggcatgggactcaaatcttgttaatgaattaggagtgatgatgtttagatgtgatgcctaaaatcatggcagctatctgtgacaagggagcctagcctaaggatataaccaatgatggctcagcaggatatagccaatgatggctcagcagaatgagtcctttattttgggggatctaggtaagcaactatattagacaacctaggaaccctttcctactaaacgaggtaatgttattttccttcagatttaagccatttgtgttgagttttctgaactctcagccaaaatcattctcattgacaggtaggtactctcattatctccattttacaaatagggaaattgggggttcaataagttaagtcagcacttttggaggctatggcaggggatcacttgagcccagaagtttaaggcagcattgagccatgatcatcatgccactgtacttcatcctgggcaacaaagcaagaccctgcttctcaaacacaaagaaaaacaaacaaaaaaaagaagttaagaacttaatgaacatcatgcagctggtaaaaatatcagaattaggatcaaaatcaagtctgtcttacatcaataccctagtggttaatttgtggttagacatcttctacatatattttttgaaacatatcacactaaagcactgaaataaataatgacaaaaatgtctagtaattcaaatatataatctgtgagaaagccactttccccagtaatgttttatatcaagtgttggtaaattgtgtaaggggtcaaataataaatattttagagtttatgggtcagatggtttctttcacaactactcaactcattgcagctcaaaaagccatagacaatgcataaacagatgagctcagcactgtttcagcaaaattgtaattacaaaaacatgtggcagaccagatttgggcctgggaccatagtatactgaacacttctctacatgaactaaatctgattctttgtgaagggttcgccagggaggatgggcaaaagctcattttactaggtgtgtaccaaaaaaaaaagtcacaccagtagaagagaaaaggagatatggagtgcagtgtggaagggacagagagtgcaccctcttcacaaactttaagatatcaaagaaaatgactgttttcctactttgtagtgcagattgggaaacagcttcagacaacacaaaaggaggggagctcatggcttccaccatcagagaggcaaagttagatagtagatttctagcctactatctgtgcttaaattggaatttctgttaaaaattccgaattttctcagcaataactttcaaagaccaccacaccattatctttctttctttcttttcttttcttttttttttttttttacagtcttgttctgttgcccaggctggaatgcagtggtgcagtcttgggtcactgcaacttctgcctccctggttcaagcgattctcctgcctcagcctcccaagtagctgggattacaggtgcccaccaccacatctggctaatttttgtatctttactggagatggggttttgccatgttggccaggctaaagacaaccgttatctttcatactcaaaatattgaatgacccacaagcagtataatacatagctgttatttctgcaaatggagagataagaattggaagtgaacagatggttatagctctttgatttttgttttaattgctttccaacaatcacagagaatggaccaattttctcaataatatttgttctgaaacaaaggtctgggagtcaagtttgtcaataaggcaaagagtttttgggaggtatgtgagggtttttctttttttttctcaaatggtttgcaaaggcataacatgaaattgactgttatttatttgcagaatcttaactactgagccatatttgtccccttttacttcttactaaactggaaacataaaaaagggtttataggaaaccaaggttaacagataggaacataaagtttcactcttctttcctgcttctggcaaccactaatttattttctgtctctgtggatttgcctattctggacatttcctataaatggaattatgtaatatgcagacttatgcctactgtctttcactgagcataatgctttcaaggttcacccatgctgtagcatgcatcagtaaataatgtcttttattagtgaataatattccattggatagatgtaccaacttttttgtttattcatcacttggtggacaatggagttgcttccactttttggctactatgtgtaatatttctataaacactcataaacaagtatgaacatttgctttcaattctcttatgtgaggagtggaattgcttggtcatatggtaactctaacatcttgaggaatgatcaaacttttctgcagaagctgcaccattttactttccccagcattgtatgactattcctatttctccacattcctgccaatactcattgttgtccgttctaatgggtgtgaagtgatatttcattgtagttttgattttactttacataaacactaacaattttggacatctttttatgtgtttgttggatgtatgtatatattctttggaaaaatatctattcaaatagaaaggaaaattttaaagaagagaagatgtatgataaaatttatattgactgcatgtctataatgcattggggtctttactcataaaaatgaataataagtaatattttaatcatattacataaataagattcagataaattaagaacttgctaaagaaaatagttggctatggttaagccaagagtcaaataagatccgcacgccttccctttgtcccatgtacatatgcttcatgtgcatcgatatgaagatgtacatcttacagagatgaataagacaaacatgactgaataaagcatgagtgtgcccctctcctctctggaaaaaagtaaaaacataaaaaacttttatggaataatgcagaaaaggatcaattctctttctgatgtcaatatgatagtaaagttgtaggtagtgcacttgtgagatcatcaccttactagtgattgatgggggcatcccactctttattgatctagtctatgtaatagcacatgagaaatccatgaaccgccctgtggagggcttatttatcttttaaaatgctataaccacatccagtatctctaaacaagtgcttagaagttagaaaacattatgagtatattagccacctagacaccactctcccctgcccagcacttagcagagtgtagattgggtacatgacagtcacgcatgccttgttgctcctgggaggcagacttgccttattatctgaactgatttcctcactttccaccccaggaatcaatacagtactcagcagtcttatattagatgctccatgatagattgttaaataaatgactttaattggcatcatacagcgatattacagaattagatatacagttgatgctcaataaatatgtgctgacttatttagtaaagaaaggaaagatgtgcttggtgccaagcactgtgaaaatcccactaccacacattgtcttcttttctcatttaggcttcgtgaaaccccatgaattatatgctttcatatattcaccttattcatgttcaaaatgccagcaagtagtaaagtagtaatgcaaacccagatctgcaaaagtacattacaaagcattaagttggatatttagaactcggcacactaaatttcatctggggctaaaacacagagtcccaatgtagtaccaagaaacaagcctttcccacttttgcttaagatgacaccaacactgccatgaagaagatgaacaggggtgcacaggatgatacttcttcaaataagtgaaatgattgatgtattgggtactttatgcaagaagatttggagaacaatgtaattgttttataatctgattgcgtatccctaagacctggatgttttcaaaatgataaatgacttaatgactgaatacattctagttgcctgttttaaacaaatgtgacattttaggggttaatgctacattcttgatttcctgtatttttagtcagtaactgtattagtctgttctcacacagttatgaagaaatacctgagactgggtaatttaagaagaaaagaggtttaattgactcatagttccacatagctggggagtcctcaggaaacttacaatcacggcggaaggcacctcttcacagggcagcaggggagagaatgagggccagcagaagaaacgccagaggcttataaaaccatcagatcttgtgagaactcactcactatcacgagaacagcatgggggaggctgcctccatgatttggttacctcccaccaggtcctttccacacacggagattatggggattacgattcaagatgagatttgggtggggatacagccaaaccacttcagtaactttctctctgtttaaaaatttttaaatttctattttttttaaagtttgaacatgttgaggttcaaatgtcttaagcttccaagtgctcttttgacttttaatatatttctggagtccctttttgtcttcttggtccttaacactttggttgcatgcctgcatttcctctcctgcttgtgtgcacttctcatctgccatgtctaggaagttgtatcctttccacttgatttagcatttctttatcttctgtcgtgcagctatcaatatgccatctagggtgggggctggagatataagacagcttaaagatatcatccttttacttaaacaactatccatcttttaaagtactttaatataattttcataacttttccggtcagccagagtgaatactctcgaaagtgtctttgacagttggctttattttttgaggaggaaacttctcttgattgactttgtttgcaccgtgatttgcagacaagatactaagaatatgggggtggtggttggggctagtgttagagttagtcctgttataatctcagtttctcaacccatccaaatgagaacaccatagaagtaaaaacatatttcctatgcaaaggctgcattaagatatgtctagttcccacctcaacccactctctaagtctttcttgcataaaatgcggagccaccacaccactactgacaaaagtgccctctccacgaactctcctagaatattttttctacttctgccatgacacttgacatagttagccaatgcataagcagggcttcaagccaggctcttgtgttgcaatatctatcctttctttataccccaggtggagaagaaagtgcttggatatctgaacactagaataaatgattcaaataagagctaaaactattaaggggaaaaataagatttttaagtaattaaagtgagtgatattcattttcatgaaggaatctgaagaatcaagtcaatgtttagacattaattcaaagccatgatggaatgaaaagaaaatgtgacagagaaagtaatagaaattccctgagtcaagcactgtctttatttttgcactcacctacctccccccaatatctactttgcacagtattttagtgtgtgctcaaaaaaatgggtgttgggtgcttgctttggcagcacatatactaaaatgggaacaatacagagaaagttgtcatggccgtgcacaaggatgacatgcaaatttgtgaaacgttccctatttttatggttaatgggtacaaaaaaaaattagaaaatgtaagacctattttttgatagcacaacagggtgactatagtcaataataattgtacactttaaataactaagagtgtaataggattgtttgtaacacaaagtataaatgcttgaggagatggataccccattttccatgttgtgattattatgcattgcatacctgtatcaaagcatctcatgtaccccatgaatatatacaccagctatgtatgcccaaaatttaaaaataaaaaatatttttaacattggtgttgggtagatgggttccaagatgaatgaactactaaaaaacgatgccttctaattgctcttatttacttattctggagtgataaatagagtgtttggcaaggagaagcttgcatatgtgtagcttaaaagagtccaaaactcagcacggttggaaatgcagaatattaaagagatttctttatggagttgggcttttttgacttttccttgcctttctatggatgaggtgtgaaataataagactgttgtgtggtccctccatagttcagtttcatttctgtaaaatgaaaatgatatttatattggattaataggtttattccaagcattattactgcatgctgacttctaaagtttctcttatcccaaggttgttggtttgaattgttaaaactataagtcctaagaacagatttatttattttatatgtatatatctgttttatttttatagatttagggagtacaagtacagatttcttacattaatattttacatagcgttagagtctgggcttttagtgtactcatcacccaaaaagtgatttggtaacccaataggtagtttttcaaccctttccttcctcccaccttcccatcttttgtagtctccagtgtatattatttaccactaaatgtccatgtgtaccctttgtttagctcctggttataagtgagaatataaagtattttactctgtttctgagtttactctgtttctgagttattttacttaggatcgttgcctccagttcctgttctattgatctgtatctatttttataccagcaccatggtgttttggttactaagccttgagagtcctagatttcataaaatggtatgatttcttttttatggctgagtagtactttatggtatttatggtatatggtatttctggtgtgtgtatgtatatatatcatactatatgatatatatatatggaatatggtatttatgttatatatatgcacacacacacactcattaatcatccattaatgaatacttaaggtgattctatatctttgctattgtgaatagtgctgccaaaaatatgcaagtacagatatctttttgatataataatgatttctttcccattgggtatatactcagaagtgggattactggatcaaatggtagttctatttttagttcttggataaatctccatactgttttccataaaggttgtagcaatttacactgccatcaacaacgtattagcattcccttttctccacatcctcacaatatctgttgttttttgactttttaatattaaccattctggctggtgtaagatggtatctcactgtggttttaatttgcatttatctgatgattaatgatgttgagaatgtttttaatatgtttattggttgcttgtatgttttcttttaaaaagtgtgtgtttatgtgttttgccccctttttaatagagttatttatttttcttgttgagctgtttgagttccttgtagattccggatattagccctttgtcagatgcatagattgcaaatattttcccattctgtaggctgtctgtttactgtatttatcatttattttgctttgtagaagctttttagtttaattaactctcacttatatatttttgtttttatgatgtttgtttttgaggacttggtcataaattctttgcctaggccagtgttcagtaaagtttttcctaggttttcttcaaggatttttacagtttcaagttttacatttcagtctttaatttcatcttgagttaatttttgtatatggtaagagatatgggtatggtttcatccgtctgcatatggttatccaatttttccagaaccatttattgaatagagtgtcctctccccagtgtatatttttgttgacttagtcaaaggtcagttcatcataggtatgtggctttatcaaatctagggctctcaatgctgtagtaaccaaaacagtatggtactggaataaaaaaatagacatatagataaatggtacagaatggagaactgataaatgatttcagtaaagtttcaggatacaaaatcaacaaggaaaaatctgtggccttgctaaacaccaataataataatcaagctgagaaccaaaacaagaactcaatcctatttacaatcgttacaaaaaaatacataggcatacatttaatgaaggaagtgaaagatctctacaagcaaaactacaaaacactaatcatagatgacacaaacaaatggaaaatcaccccatgctcatggatttgaagaatcaatatcattaaaatgactgtactgcccaaagcaatgtacatattcaacaccatttgattacattaccaatgtcatttttcacaggattagaaaaaaaatcctaaaattcatgtggaaccaaaaaagggctttaatagccaaagcaatcctaaacaaccagaacaaagctggaggcatcgcatatctgtcttcacattatactaaagacagatttataccatgagagtagacctgatgtacagcagtgcacttcactaattgtattgactgttaagaaattacaataattttattctatatggtaactaaccactgctcaaatcccccctgaaaattgtccccccaatgccaccctggatgcctgggttcccaaatctcctcagtgttaatccagaaacaagagttaacatttagccccagagggacctccaggacgctgcttctctcttatgaccgtacagatttattctgattagtcctgtaatttccatatgacttattaaatattttgaacatcacatccatacatactttccagacaagaaatttggatgtgggagaacattctttaataaagaaacacataaattctcatttaaaaaaactgctttttttttctttcttttttttttattatactttaagttttagggtacatgtgcacattgtgcaggttagttacatacgtatacatgtgccatgctggtgtgctgcacccactaactcgtcatgtagcattaggtatatctcccaatgctatccctccccgctccccacaccccacaacagtccccagagtatgatattccccttcctgtgtccacgtgatctcattgttcaattcccacctatgagtgagaatatgcggtgtttggttttttgttcttgcgatagtttactgagaatgatgatttccactttcatccatgtccctacaaaggacatgaactcatcattttttacggctacatagtattccatggtgtatatgtgccacattttcttaatccagtgtatcattgttggacatttgggttggttccaagtctttgctattgtgaataatgccgcaataaacatacgtatgcatgtgtctttatagcagcatgatttgtagtcctttgggtatatacccagtaatgggatggctaggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttcatgtgttttttggctgcataaatgtcttcttttgagaagtgtccgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtaatgcctaggttttcttctagggtttttatggttttaggtctaacgtttaagtctttaatccatcttgaattcatttttgtataaggtgtaaggaagggatccagtttcagctttctacatatggctagctagttttccaaacaccatttattaaatagggaatcctttctccattgcttgtttttgtcaggtttgtcaaagatcagatagttgtagatatgtgacattatttctgagggctctgttctgttccattgatctatatctctgttttggtaccagtaccatgctgttttggttactatagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttgtatcctcttttatttccttgagcagtggtttgtagttatccttgaagaggtccttcacatcccttgtaagttggattcctaggtattttattctctttgaagcaattgtgaatgggagttcactcatgatttggctctctgtttatctgttgttggtgtataagaatgcttgtgatttttgtacattgattttgtatcctgagactttgctgaagttgcttatcagcttaagcagattttgggctgagacaatgcggttttctagatatacaatcatgtcatctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatatctaatttattgagagtttttagcatgaagggttgttgaattttgtcaaaggctttttctgcatctattgagataatcatgtggtttttgtctttggctctgtttatatgctcgattatatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgagtctctgcccagctttggtatcagaatgatgctggcctcataaaacgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaatttcttcctggtttagtcttgggagagtgtatgtgtcaaggaatttatccatttcttctagattttctagtttatttgtgtagaggtgtttgtagtattctgtgatggtagtttgtatttctgtgggatcggtggtgatatcccctttatcattttttattgcgtctatttgattcttctctctttttttctttattagtcttgctagctgtctatcaattttgttgatcctttcaaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatacatcccagagattctggtatgttgtgtctttgttctcgttggtttcaaagaacatctttatttctgccttcatttcgttatgtacccagtagtcattcaggagcaggttgttcagtttccatgaagttgagtggttttgagtgacattcttaatcctgagttctagtttgattgcactgtggtctgagagacagtttgttataatctctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattggtctgtctaatgttgacagtggggtgttaaagtctcccattattattgtgtgggagtctaagtctctttgtaggtcactcaggacttgctttatgaatctgaatgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttcccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacattttggcatgattttgcagcagctggtacctgttgttcttttccatgtttagcgcttccttcaacagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacctgacctttctctctggctgctcttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggctccattctccccatcactttcaggtacaccaatcagacgtagatttggtcttttcacatagtcccatatttcttggaggctttgctcatttctttttattcttttttctctaaacttcccatctcacttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcttctaaagccttctctcagctcgtcaaagtcattctccatccagctttgtttcgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacgggaccctcagctgcaggtctgttggaataccctgccttgtgagatgtcagtgtgcccctgctggggggtgcctcccagttaggctgctcgggggtcaggggtcagggacccacttgaggaggcagtctgcccgttctcagatctccagctgcgtactgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcccggctgctttgtttacctaagcaagcctgggcaatggcgggcgcccctcccccaacctcgctgccgccttgcagtttgatctcagactgctgtgctagcaatcagggagactccgtgggcgtaggaccctccgagccaggtgcgggatagaatctcttggtgtgccgttttttaagccagtcggaaaagcgcagtattcgggtgggagtgacccgattttccaggtgtgtctgtcacccctttctttgactcagaaacggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcggaaatcaccgtcttctgcgtcgctcacgctgggagctgtagaccagggctgttcctattcggccatcttggctcctcaaaaaaactgcttttttacacggaacccacgaacatgaaaaaataaaaaaaccttgattattagcctcaggtatgttcacaaaagtatagatatgtttttcatcattcatttccaaaaacattatcagagatttggagcaaaaaggtgctgttaccttatcattctgaagttttgtgtatgcctatgatgttggtataattttcattgttacaaccattatgatacttattcacagaaagcgtgcattaagcacttattgtgtgtcaggctttgtaataaattatggtgatacagagactgacttgctaggtccctaagatcccataatctagtttgagaagagtatggagaaggaacatgtaagcagttaaactgcaattcagagtgatcatcacagtattagagatgaacaggaagtgtgcctggagctctgaatactttcagccacttctaacctgaggagctagggaaaacttcagtatgtgcttacatttcacataaatctgaaacaattagaaattatttgttagagacatacatgtagctgtgtatgaggtaaagggaatagcacatttaaattcatagagtctaaaagtcgccatatgtgttccagtattattggagctcaagaaatgtgggaaagagactaggaagtgcagtcccagggagccttctctgatggcttgtgtggggaattgctgaataagctagaaagggtttatcaatctcgtgtaatgaagactcaatggagttttagccacaatatggagagctcacatgtgctattgaggtggttgtgttaactcttcttttttttttttttagatggagtcttgtgctgtcacccaggctggagtgctgtggcgcgatctcggctcactgcaagctccgcctcctgggttcacgccattctcctgcctcagcctcccaagtagctgggactacaggcgcccgccaccatgcctggctaatttttttgtgtatttttggtagaaacggggtttcaccgtgttagccaggatggtcttgatctcctgacctcgagatctgcccgcctcggcctcccaaagtgctgggattacaggcgtgagccactcgcacccggccgtgttaactcttagtaagtagtagaagccagtgtgaggtacagggagaccagacaggaggctgtttctatgtgtgagaaacttttatccactagaagttcatataaagacacatttgggaaataaagttgttgtagagaaagatacaccatccccaccgtggatagcatccagattaatgctggaaatcacatttcaattagaaaattgcttaggaaacatgatgtcagaagaaggagagccatgtaattcaagtctttggtggcatctctttcaagtttcccagtgcacctgactcagaagatagaatcagtctgttagctgaggtctctctgtgctggagaagcatgaaaagggccccaccagcatagactcagttctctttgaagtttaagatccatctacaaatggccatgttctttccttagcagaaggtattggggtttctacatacatgctactcactgctcacgtgtaagtaaggtaaaatttgagcaagtggaaaatgaccctgctgtaatccagatcataatatttctaaataagcacacacaatagtcaaccaacctacttcatgatcttttatggaacaaggcagagacaaggccactctgcacccacaaaaatgtataagtatgcacttctgacctatgtgaggtaagtgtctgctacttctctgtcaatggcaagccctactaccgtcctccagcatattggatttgtaggccactcagttagcaattgtcttcacttctacatagcattcaatccttaatgtactcctgcttttcttagcctatagagtagttcaaactcccagggaggctgttttgttagaaggaatgaagtcactatggatatattgaaaatctcatctacaatagttaaaagtccataatttagggttagtgtgaggatattcattcaataagtatttactgaataactattggatagcaggtgatgagttagttattaggaatacatatacccacatacatgcacaaacacacacacacatacagacacatacacagatatataacatgtttgtatcttccagaagcatacggtttatgggataaacaaagggagataatgaaggttattatttctagtagcaagtttgagaatatcccatagggtgaggctcatttttgttagactttgataaatcatctcaaaggctaggcctcccagacgtgtgtgttatctgtggctcaagactatgagtagcagtcatagctatgattgaaagaatgagagacaaagagcagaaagagtggggagtagttctgtgacctaaatggtgaaaaggccccagagaagaaagcctttactgggcaacactatagagagttttgtagagaacagaaatatccaatgggaatttattttttgctaaagttttctctgtcttataatatgttatctggatgaaatctgtggacaactgtgggattgtgggggtgcaaggtggcaacctgcagagcaaagcatgtgcaaaggcctgaggggacatgggaaatttaaacaattgtggcttgtgtattgaaagtggggggcagttattatgtatgagatgaggagtgagagacacagagggcttgggaagattttggtcttcatcgtaagagccgagataagccatgacatgattttttgaacagcagtgactgattgctatgtggtttttttttttttttgcatatattatggaaacagattttattgtaaataattcattttagggtgggtagcatgtgcacagacaggtctgtaaggaatattccaggtaagatgagatggaaagaagtggtaaattcaaaagatatttaggagttagaatcaagagtatttggtgattgcgcatgcaggatcaagagaatggctactaggtttctggcctggacaatgggatcagtggtgtcacattaactgagactgggagtgctaaagtgcaagtttcttgaggaagagcaagaattccattttctataagcaaattctgagctgcttttgggatgtccatcaagaggggaaagataagcacagtgtgctgcattgtgccagcaacatagaaacctccgtaagtaatattcaggttcaactcagtagttaatattcaggttcaactcagtagttaaggaagaaaccagtcatcgtttcaattcattaataaattaactttcattgcaaaatctgtggggatttctgtcttccaacccaacattttcttcccattttgcctttaatgaattcaccaccaccacctctcactgtgcatttaattactctactgattacttactatgtatgctacgtgatgtggaaagaatagaaaacttaaaagcaaagcactctccctgacctccctggggatagagaccgaaacgtataaaaaaaataagaaaacacattaaactacatgtaacaagtgccagatgagtgatccagataattgcacagtccctgtggcccctagtgatggggtactatttctaatgccagcagcagtgcttccttaaactgatccctagaccttggtcatggtgcttggaaaaccctttcttagcaccatctctgctcatcttaatcctaacactcctttattcttcctgtccctctttttttggaaaatcctttccaattgttttgctttgttttcttctcgtttgtcctctatgctgctgggctgatttttccctcctttaatgaaattccatgctctttctctaagttgttttggagcccttcttatatcctaacttacttcgcttcccagaaatttttaaaatagagtttttgttcactataacactttttttttttttttttttttttcctgttttgagacagggcctcactcagccctgtctcaaacaggctggggtgcagtggcgcaataccagctcactgcaacctcgacctcctgggctcaggtgatcctcccacctcagccttctgagtagctggggtcacaggcgtgcgccaccatgcccaaataatttattattattattatttgtatagatgggggtctccctatgttgtcgaggctggtcacagactcctgggttcaagtgatcctcccaccttggctcctgtagttctgagatacaggtgtgagccagagtgcctggcctgtgataccactttttaacacaaacaattagaaaaatgctgtataaaaaagttgtccttttttttttttttgacagagtttcgctcttgttacccaggctagagtgcaatggcgcaatctcagcccgctgcaacctccacctcatgggttcaagtgattctcctgcctcagccttccaagtaactgtgaatacaggtgcctgccaccatgcctggctaattttttgtatttttagtagagacagggtttcaccatgttggccaggctggtctccaactcctgatctcaggtgatccacccatcttggcctcccaaattgctatgattatggatgtgagccaccgcgctgggccaaaatttctcccttctgtaaattcctattccgtgcctctgtgtcatgccatccataagcccaaggattaaagatgtgaagacctgctctgctcagtggaagcaagctcatggtccagtcagacagtcagatgggagcttcagaagctgatggatgtggagagaatgatgtctgatagcagggcccactctgaaataagggaacttaaagaaagccttgaaatacaaattggtattcacgggaacataaggcccctcctgtttacttacaggaaccttcatccatataattgttttgaaggcaatagctctataacaaattatttaccaaattacattcctagaaacagaagtttgattaagtacatgccaaaatagtaccatatagcatagccagcttagtgtattggactgtcttaaaagtggcatagctttaaaaaatataaacaagcttccaaaagtgttgaatttgctcacagatgagagtttttgattactaagatacaccaaggttgtttaggatcataacttttatagtttggcattagatcttatccatgttctcattctcacaaatgttccgtgtttcttcttcagaataaaacactcagctggatacattagagcacactgtgccaccttagggcacagaaagaaaataaagaattgcaccttacattttatttttggctcattcttatttatgttctattttatgtgttttgtagtgtatcttgtatgttgaaaattaaacaaatagatgtatgaatacatacatgaactttaatcagatgtacaaatgtaggaggatatcatccaaaattattagcatctctttagtaggctttgtttggttgtaagtgatagaaaacctcagtaagagtgacttggacacagtatgcttattatttagtcaagaaaaatctaagtaggtggtcttagagttagcgtagcaacctcgtgagtttattaagggtccagaatttgcctatatttccatacacatattttgcatgatgactttcaagaataaaatttcacctcatgatgaattacacttaccttagccaatgcctctgtgatttcaggtgggtaatactatgtagataatatatagtaaaatgcataggtatattctaaggtttcaaatgtattgataattgcagttatttacttagagaatgatcatacccaatattttattattgtttattatattgtcattaaaaagttataataatgttgttttctttgaattcagtaaagtcattgtgaaggttaagcatgtgcattttaaattaatttggagattctttaagctatggaaatggaaagcctcagtacatgttaagcctgatatctgagctttcccaccccagacttttgcagagccattgacttgggtctctgatcctctgtaatgtgctgatagatgataacatgatggagaaatcagttggtagaatggggcggtaaccactagagatagcagttgtcagatggaaattaattgattgtaattgctttgccattgtattgcacttgaagtctgtagcttgttaaaaccactgattataaaataaggatctcactttttatgctgtagattatgttaatgaaagctgttcttagaagcatgatcagtgaatatcaataaatggataataagaaattaaaggaaaagttaactaactgatcatgagttaatatacttcagcagccagagtagcagtcaactgtgcaccgtttcatattgaattttttgctcagagctcttgaattttaaatatttcccatagagagattgattctgtgtgactgtttatcacgtactgtcttgaataacagatcttttctgtagagaatctcctgcaagatggaaaatgtgtgtgttttgcagagcctttattttgtgccaaagtattaacaagcagatattttgaaatggaaaacataagttcccattgcaataccaatagtggtttatttcagtgctcgtggaatatgagtaacatatgtgtgagggtctgtgtgaatctgaaggccttgctgttgcaatctttatcaatattataaaaagtatactaaaatgataacataaatgttaaattatacttcactttttgctgtacaaaatgcgttaacttttataaaattataatgaggtttttaattatagctttcatttatagcatttaattgttgatgttagagagatcagagattttggagatatttttctgaacaccagttctcattaagcctccatgcaggccctcaaggaccttacagaagaaaggaacagataaaacaaagaaaggattacttgcagtgttgaatgcagtgatgaaagtgataagaggcactgggaggcacaagatgagatcatctaagttctgaggatttctgggtgtcttcaacaaagaatgaaggtctgggaagaaggagcagtgtgacagttcttggtattttggggaaatagaatgatagttgaaaattaagttgcataaagttttagagtgcaagaagagaccagacagataaacatatagatggcccatgccctggtttgccctactgtggattttaaagttattcccacaggagagcccatgaggatttttagatgtgggagagacaggggtgagtttccttttaaactgctcgctcaccatcagttgtgacgataatcagggaagaagctcattgtgaccttcatttactgtcttagtccattttctattgctttaactgaatacccgaagctaggtaatttataaagaaaatacatttattttttgcagttttggaggctgggaagtctaaggtcaaggggctgcatctgctgagggcattcttgctggcaaggactctgcaagccctgaggcagtgcagggcatcacatggatagggagtaagagcatgtcaactcagtccttctttctcttcttgaacagccaacagttccatcatgggggcctcaccctgatgaccttatccattcctgattacctcccaaagggccccatcttcaaatatcatcaacatatgattttgaggattaattttccaacacatggaatttgggagacacattaaaacaagagcggttaataagctggtataatatcccatgcttgaatattattattaatctaaatctctgtaaaggaaattaaaagcttaagcattgaataattttttcttctttgactttttaagtatattttttgttgaatgttgtggtggaattggagctaatagttgcttaaaactctgtaattggaacaatgtctacatgtggtaatagagtctgtatcttatagatagcacttatttattgttattctcatatttgggatgcagatattgatgtataacttaatttgaaaatgtaagtaattatgattttaagaatgcatgtttaagatatgctaaaaaatggcaataattggtcctgttaaatatttaccagaaacattcttcatatttgagaatctgtttcagaatttagaacatttgcattttaattacataataaaaggagaaagtgaaagaataattggcttagctattagccaattatagctgtaactgaaaaaaaaatcccccaaactgacattggattccacagaacagtcacaatatacattgatcagatgtttaattatatttggcagcaataaagggaagggaatgttgtttcaatccttcatacaacatgtttgttaaaactgaaattaatgagggtggatttggggtgtttgacttaggatcattcagcttttagtgtttacttgtccacaaatggggcttctccagagtgactccaatagataaaatttagtggagaaataagacaattgaatatagtggttacagccagctgcatttggtcagtaccaaggagggttggagctgtctgtctagagtcccagaggtcagagcccatgagaaggcctccatacagagatccagagccagtgacaggagttgttggtgtcagaatgtactgctgacagcgtttccccctgtgctttccctgacagatacgacgacatattccacagagcgatccgagcacttcaaaccctgccgagacaaggaccttgcatactgtctcaatgatggcgagtgctttgtgatcgaaaccctgaccggatcccataaacactgtcggtaagccactgaggccactgatggaaagggcaggcccgttgcaaggcgtgggggtggagggtgctggcagcatctggtatgtgtcatatccgggatacacacagtcccaccgtttgaatagcagaattgcgagtcttaatttggaaagggcaaggctgctgcctctttaacagtggaagaagacaaaatggaaacaaagtagttacggtttaagttttacctgaccaagcaaacaaagatttacttttagatctgcaaagttaatggaaataattatttacacactttagaagcgtctgtttatgatgtggagcttaggcatatatcctagtactcagaaataatctgttcttgagaacctacagactgtggcaggagaagcaaactgctcatctaagatctagaatctcagtgtttattgtgaaccaaccccagagacttgaactgtgtccagagagaactgcattttattttgtttctgccttcctttattaatttcagtactttttcttaacacctctgatgaaacactctccagcaagaagttgtaaatgaaatagtagtcctgttatagtctaggtagagaactacttggggaaaactcccagtagagatcaggaaggtgtttaattggtttttagagacataaggttatgtaactgctaaaaataaaaacaaggggggataaagagtgcacttatagacactgtggctttaagactcaatagaagaatcaaattaacatctgaaaaatatttcttaccaagctttcatttccagtattaccctggtaatttgtttttctttgcaattgtgtatgcatcagtgatcatatatatccacaccccttttcttctctttatttactcttctcgtatgacacagttattaaattaattattctgaatagtgaggcatggaaaattatgacttttttctattactattataaaactctattcccatgttgtttcactaagatggtgtagagaaatgcattgtatagttatgaacttagaacatgccatgccagcagaagctgcctggatccaagagccaggtttagtccacagggaagatgtattgccacactgagcaatggcacaggtttggaagaacagatacgtgatatagtaggagggctctgtaaaagttaccatatgtcctgtgtcaggacaaatagaactgtgacctttcctcacccctgacatgtggtgttcatatatgactttggcagtgccgctgcattcaccctagttacaaaatttgcaccctattcctatgctctgcaaacctgggttggggaagaaggggagtggggattgtttctctccacactcctcctctctcatatttattgtgactgtgcatgtatggatacaaagcacacaagtgacattaagaccttaagggaaaatccaggaatgagctactccttcaaagcgtgatgtgcatgcaagctcttttagatcctcaaccatgttacagtggccaatctaatgggataatcatttggaagtggccaatgcaatcaattatgtttgaattcgtaatcaattgaagaagggatgaatcagaagcattagctaaagtagtggctttctttgatggtgttttaccaagaggaggaatcagatcaggtcccaccacagtatgcaggctgagatgattcatcttttccaaaaactgagactatcaggagaacaaagtaattcttctttttctgcatatggctatgctgtattcttcattacttcatgagtgtatgaatttgctaggactgctgttacaaagtgctacagactgggtggcttcactatggaaatttactttctcacagtcccggaggtcagaattccaagatcaaggtgtcagcagagttgattccttttgaggcctccctccttgacttatagatggtcaaggagatgtaccttattatgtttcctctgtaggtgtttgtgttcagagttgattccttttgaggcctccctccttgacttatagatggtcaaggagatgtatcttctcatcatgtttcctctgtaggtgtgtgtgttccaaatttcctctaaggacatcagccatattagattagatcacatcctcattaccttattttaacttcattacttctgtgaagacctttctccaaatatgatcacattctgaggaactggagtttacttcatgtagggattttatatttttgtagataaattcagtccataacaatgagtctcatgtccataaaagaaaaatcctttgcttttgtgagatgcatgtacatctctaatttttgtaacacacataagcagatatatacctatagtttaagtgaaatgatgtacatatttaataattttggccttctgtcttcatatttcttgcatatttcagtacagacagcctgttatttaacatagactcacaacatagctaatcatgacaaaagactagcctaagacaaaattggaactcgagtaggttaatagatgcctataaatctcctactggtgtgtatgaataaatcacacatcacatgtgcctgctattcatctctcaagctttgctgtgaataaaaggcttacatttgttcctgcatcagccacttctaaaaattccaatgtagttattaataaagtgccattttgtacagcactctatttaagtagtatgtttcagtcatactcctattcaacaaatgtttactgagcacctcctatcactaagatactattgaataaatacatacagaaatgaatttaaaaattaaatgtcacagtgctttgtaatgtgtttggagtaagaaaaatacttcatcgttaggaaattttaaaaagcaaaatacttcagtgactgacatgctaccaggagtatgtttatgacatagtagttactggattttgtttcaagttaaataagatgccatttaatagatctgagcagcaatataaaggcttatgcatgaccctggcttattcaatagtttatttttttgtgtctcaaaagattagacatctaaatctgaaagaaattaaaattatatttcctagattaaaaaaaattgtaatcctataataaactgcatcaaatatttttctgtgttgtgaaaatagaccatgctctgacacatttctgttttcttctcaaggaacgataagaacacaattaccaaactattcgtgatagaaatcctgaaagtacatgcaaaaaaaaaaaaaaaaaaaaaaaaaaaaaaggacaataataatcccagaaaagggaggagttgaaagtgggggacatgtttgtttcttcataattttcttattccagttcttcaagaaacacttgtggtaccagtacttagaaattataaagcaatttaattaaaaaaaaaaaacttgacagaaggatttttaaagaacaagaaatagagaaaatagattttcctaaattcaaaatataatgtgtatatatatatgtgtgtgtgtgtgtgtgtgtgtgtgtgtgtgtgtgtgtgtgtgtattttatttttctgagagggacccttgctctgtcactcaggttggagcacagtggtatgatcttggctcactgcagcctcaatctcctgagctcaggccattctccctacacagccttctgagtagctgggactacaggtgctcaccaccatgcccagataatttctgggtttttttttttttttttttttcgtagaaatggggcctcactaggttgcccaggctggtctccaactcctggacttaagtgatcctcctgcctcagcttcctaaaatgttgggattacaggtgtgagttactatgcccagcctgaaaatataaagccacagattatccacaggctaattagtgaaaacagattgtggtatattgtgggacttagtatagaacaaggcttgattcataaaccagaggaaaatgagagactgattgttcaataaatgattgactatcaggtaaatagaatcagaagtgtatgttgacccctctttctataccaaaagtatactaatgatttcaaaagttaatgtaataaacaaataaagcctaaggaaaataataagtaaaattacatgtttatttatgttcagcaattgtaaggaccttgtgagcaaataaaagcaatggaaggcaaaaattaacaactttgacacagcatttttttatctgaatatcataaatcagaaacaaaattaaaagacaaactgtgaggaaaccgaataacaaatatggcaaagaattaaaaccctgaagaagtcatgtagatcaaagggtaacattaaaataaaagctcaatagggaaattgacaaaggggaggaacataatctatctaaaaagaaatacagataaccagcaaacaaatatactcagcctcacagagaaatgcaaattaggtgtttttttcctatcctttatttaaagatttttaaaagtgactactatacccagtttggtaagggggctgtgaaaacacgtgtccacaaatactacttgagggagtgcactttgttaaatattttttgtaggtaatattttagtatgttttaaaagccttatactgttttttgtttgtttgtttgtttgtttgttttttgagacggagtctcgctctgtcacccaggctggagtgcggtggcgtgatctaggctcactgcaaactccgcttcccaggttcacgccattctcctgcctcagcctccctggtagctgggactacaggcacctgccaccacacctggctgattttttgtagttttttagtagagacggggtttcactgtgttagccaggatggtctcaatctcctgacctcgtgatccacccacctcagcctcccaaagtgctgggattacaggcgtgagccaccacacctggcccatagacatgcttgtgaatatttatttgtagggatgctcaccacatttttatctgtaatagcaaaaatttttaacaagtatgaattatgaatttaaatgtctatataaattagaatatatttgtacattgaatgaattttcacagtgttttgaggatatccaatggtcactatgtcatgttaggtataaaaatgtaatatgaaattgcaaacttgaacatatagtagaatcctaattctgaaaaaaaaactaaaaaggttgatagtttacaactatttccttctttcaacttggcaaattttctaacatctctatattacacatatatttcatttatgtaacacccggttaagagagttgactcctgcctctagtctttccattaagaaatatagatagtgtccttgtctctttaaaatcaaggtcattataattcactattattgagctgataagagaactttcaattaagtgcttccagattaagcactactaagtctatttgaatgtgtctgctccttcttttattaataattcattgatactttttataataattctttttcatgttgaaatcatgttttgaaaacattaaaaacattggatttaataaaaggtagatacaccccatagaaatgaagctggatgaagaaggaaaataagtcagcagaaacactttgaatcaaaatattctgaataaaatcagaatattctatgatcttttcatttttatgccatttctagaaattttaaaaatgttggcaatggtgctatgtataatatactgcactagattgaaaagaggtagccactgtaattgaaaagattgctacacatttgaatggaccaaatgtgttttaagaccaaattcaagtaaaaaggatgtgtctcttctgaactgaagctcattaaatgtttcaccggccttcctgcaaaaatggattttcaaaactttggaaaggatagcatttaagctgaatttgacctgtattgaccattttggaaatcagccaagcaattcgcttgaagatacttgaagcacttgaaatatggaattgctggaaaaagaataagacagcccaatagctaccattgcccagggtgatactttggtaacaggactgatggcttgtataacaatctgacatgctgataggagttggggagtgggggcagccattgggaagggcaaagggaaccctaagagtagttttttctccctattatgactggctgtctctgagtaggttttgaaataaaagcttccatttttaagagaattgattggtcattgcgtaacgacaattctacgatataacaggaccatcccagttagtgctttgccctgtcactttggaggtccattagctcttccattcagtgagggtcctctatatcaaatggttctccagtaagtgctctgagagcagcagctaatgattccctgtggttgaagcaagtcagaatgaaaatggagttttggcacacatccctgaattccatcgacaggagggaatgaaggctaaaatatctataaatccaggccaggctgcagagtcactgcagattccctgcagagtggtgttaataacaaggtgaagaaccttagaagaatttgcaagttcatcaaagaagtgttcatgggaatgattgccatagcccagacataatttaagtaatttgcaatagccatattgataacaggtggtctaccgattgcttttgacaagaggaaatgaagaaagttataattattcttcctctctgtggacatagcttgtcatgatagtcttagaaactcggaaagcaagcaaaccaacaacacaatgaatgttattttgtaattccatgacacttaagcagtggtttacctcttctaattcgacctctttgtattaaaattagttggcagttagtacattgctttggatatggatatttaagtatcatgcaaaaaaacaaaaaagcacattcaaccaacacatcatttagttattagccaaagattactttattttaatgttttcttctgtgattggaatttagttattagccaaagattactttattttaatgttttcttctgtgattggaatttagttattagccaaagattaccttattttaatgttttcttctgtgattagtggctctatctgaagcaggaaatggtgttttttaaggaggtcattatgacttgggtttgcttttgtatccaagaattgacacaaatttgtttatttaaaataccttccctgtgtgagttggggtaagacatacaagaggcaaatgtgagtgttcaaagctgagagacctgagttcaaagtcctactcagctttctactaactctgattttttgcaagtcatttaatcagaaccttcaatatttaatttttttaagatagtctaatagttgccccaaaaggccaatgaaagaattgaaagcaacatatagaaaactatgactgtgaaatagatactatgtatatatatgatagctctttcctctctcctttatgctcatattgaagccaaggaaaagcatatttcaagaatcccgtgagagaaattgtaccagtatcatctgccttatttaattaacaggagacttcggtttaaaagtggggaggggcatgccagagaattcctgtctactgtatattctcaggactcagaattcctatcgctaattttaatactttgacaaattagcaattttctattatttgttacattctgcaagcatttcttgatttttccctcattgcttttcttaacgactcttcatgggtttaaaggaaatattatttttcctttcctacttaatcagcgtaacgggccataattgtgtcaataacatgaaattgttgtcgattttgcaattttgtgacacaatacaataggctgttgacttttttatttttttattttttttgcagaaaagaaaaatacactttcatgtgaaaatgtacacactgaaaattatagattttacttgtggaaaatatatgattcaagaaaaatgaagtgatttacttttttcttaattctttcccaaaatagttttctgaaagtttagctatctgtatacttcagtgtttaaaatatgtaggcactaaaattcttaatggcataaaataaaaataatctgctttacgaaagcctacagaaaataatttaaaaggaacattttttaaacgcaggatatgttagcagcgaatatggaacccaagataagcaaggcgtgttcgactctacctagacagtgtcagatctctggcagttagtacattgctttggatatgtagcttttagctgctctcctttgtaagttttaagaccaggcttgtttatgtataactattcaatgtcatacacacacggagacgtgcacacactctttttgtttgctcccatgatgatttatttaccagctgtaaaatggggatgatgataactgtccttcctggcagtcattggaccataatatatgtgaatgtcaattggaagttgtaaaatgccatataaatgcaagatattgtagctatgcaaaacctaaaattacctaattgattttggtctgtcccttaacccttataatgagagtgctagcaactaaaacaccttgaaaattactggagtgtttttatagccaatagactccagaatttatatagcacttagaactttatcaaactttctttgtactagtctgattatttaaagaagatctcactatataatgatgtctttaaaatatttaattttaaaaagataaaaatctttttaaaagataaatattttttaaagataaataagaatatttttatttccttgcagactctttaaaaagtgttgtctttttgtcttctgtttttcctaataattcttatttggtctggctggttggattcaatgctccactgctactagcagacaaattatacatattcttgaccgaacgtggtggctcacgcttgtaatcccagaacttaggaggctgaggtgggcagatcacatgaccttgggagttcaagaccagcctggccaacgtggcaaaacccagtctccactaaaaatacaaaatattagccaggtgtggtgatgcatgcctgtaatctcagctacttgggaagctgaggcacaagagtcacttgaacctagaaggtggaactttcaaggatgcaataagccgagatcataccactgcactccagcctaggtgacagagtgagactccatctctaaataaataaataagtaaataaataaataaataaaacatattctctgtgattcagttttcttatctgtgaagtgggaaaaacaatattactacttcccaggattatttgaggcttgatataggtaaagttgagatgcctggtattgagtaaacacagggaatttggggtaagtccagtataatatagtaagttacaggtattgttactttatctgcacagctttgttgacaggtcagtgtacttgtgtcagaacttcttgataggtactcagagtctcccagcacagtgagtcttgtgcagagagttcaatttagatccactaatgggaataaaagagaacaggcacagatacattatttaaaaacacaataataccagatcgtgcacaagaacacattttagaatcaaggatcattgtaattattcaagtagtaaacttaaaagacaggcagaaataggaggccaccttttgttaggggaatgctcccttttgacagttcctgaagaaaaaacatgggaaaaacactccttaccacctacagtttaggccattcctgctgttgacccttcagatgtgtccccgaactgcctcaccaggcacctgcttcctgcctgagagtttcactatcttgtgagggatgggacagtctggaagcttctcccatgcagacagagcagagagagaattatgcaatattttgtatcccagataaaattatatagtttaagtggattatggattatttcaccaaatttattttaaaaattaagaacatatccataaatattattttagccagagatgatctatcagtacaaatgtgaacagtaaccttggtaccacaggccccgccgtgcaagcttcttgggtaaatatttcaataaaaccttctcaaaacaggataaagatggctcagctgttctgtggactctgccgaggcaatgagggaatttgccgtgtccttctgtggtctgcccatctctggggctactgaaaggattcttcctccaacctaagtttcacagcatcaggcagcacttctgggttcctgagcatgctatttctttccaaatcacttttgtctgatcatcatttacaaacataaaagatggcttaagggccaaatcacaatttttatgcgtaaaccaaaatgtcagtgtttgtgtaccagactagggaggctgacaccaggttctacatgcttcgcctccccactaaactctctcctttattgtcccagtggttcaggaattcaaactgcttcaaaataagacatttaaactctggctttatgtactctacttatttttagagataggttcttgctctattgcttaggttgcagtgcactggtacagtcatggctcactgcagccttgacctcctgggctcaagtgatcctccttcctcagcctcccaagtcactgggactacaagtgcacaccatcatgcctggctaattttttaaagtttttgtactggtggggtctcagtatgtggcccaggctggtcacaaactcctggccacaagtgatcctccttccttggcttcccaaagtgctgggattataggtgtaaaccacggtgcctggcttagctcccaaaacttttcaggcataatgggaaattttaataactttctctgtaaaataagcataatccaaggatgttccatgatgagtatgacatatacttgacctaattataatttgattacactcaaattcatagaaaagcaagactatcatatactatgtggatttttcttaatgtaactttcaccagaatgtacaacctctgtattgttatccccactttgcagaaatcagctgtgagtttcctgagtcactcagtgctagcaggctttggatgataatgaaacgagagagttccctgacatatgacaggggtgtggctcacctgtttttggtcgtcccccagctgaaacccctgaaggaggggaagcatgcagaagggcagtgcagaggcgggggcaggtgctttggctccacagtggtgtctggaggtggatacctgcaaccctccacgttacaaagctctttcagttttgccatctgcagatggcttgagtgttaatcagctcagtggaccctctgctttatcgcaagggcagggggccagtgtgacagccttctgtatcccaagctcttgcccagtggctcagaagaattggatcacatgcaggctggaaggatgagtgcaaggttttgttgagtggtggaggtggctctcagcgagatgatgaggagctgaaagtggggatggagtgggaaggtgatattcccctggagtggggctgcccagtggccagcctcctccagtcaccccctgctgaactcccctcagcatccagacatccctcctcttctctttctctgccgcgtcgttctgccattgctgatctgctggtctgccctggagcttgtggttcagggtttatatgggggcaggataggggaatggaaagccaaaaggcaactttttgggcatgaaaacagaaatgcctattcttattcagggatgcgggcatctaggcttaaaggtggggcctttgccagggaaccaccctcttcaacccagtattttcccatttcctgtccgtatcaataaggtagaagagagcgccctaaaacccattcttttcactgtatcccaactctgtgtcagtgcacgttaacatccaactactcttttatttcgttacctatgtacctacgtattacttgagaaaactaaaaaattgacagaagggccaagcattccttgttttatagaaaaaagccaaagacagtgtttccagagtttatctcagagtaaatctctaaaaatatgtttatttttttaatgctcacagcgattctggtggctttatgaatatcaggaaaatatttctactaaaggcagcttaaaatccaccttacaaacacacacacacacacacacacacacattcacacacatgcatatacacacagtctgtttactaggtatctggcatcatgcaagacactgaggttcagtggcaaatgagaccaaaagttccttcttgtcaataacttgctataagagcactgggaagccaacagaatctagtgtggaagggaacacaatgggcagattctgaccatactgggcagtgaagctcatatttgggattatagggaaacgcattctaggctggtaaactgagggaaaatatcttcctcaactatataaaatccctcatgcaagttttatcaaatgagaaattaaggataaagtgaaaggaataaaaaagatgagagcattacacctggtttggggaatatgtttttagaaatatacatgccatatgtgaggctatagaatggcactttttgttctattttatgtacactcagaagtaaatgacaatttaatacattcttttatcattctgccaatgtttattaagcattttcaatgttccgagtccactgtaaagtggtaagaatatagtgatgaatgttctcagaaaaactcataagagaggggttgagttggatattttctacttcaattcaatatgacaagttctgtgatagatatgagctatgctcatatctgttttgtgttgctgtaaaggaatacctgaggctgggtaatttataaagaaaaaaaaggtttctttggctcatgattctgatagttgggaggttcatgattgggcatctgcatttggtgaaggtctcagggtgcttccactcctggaggaaggtgaaggggagcattatgtgcagagatcacacaaggaaagagggaaccagtggtgaggtgccaggcttttttcaacacacagttctcttgggaactaaagaatgagagcgcactctcctctgagggaaggcatcaatctgttaatgagacatctgctctcatgactcaaatacctcccaataggcccctcctcccaacacccccacaatgggggtctaatttcaacatgagagtatgtggggacaaacaaaccatatccaaatcatagcactcatatgtacatagaagattccaaaaatcagtgctcatgaagccaggacgggcttcagagaggagataacacattaatttgcatttggaaagataagagcctttttatttctcatttggaagcctactcttgctggccaacaaaggcttggagagttgagctgctattggagaagtttctctttaaatccaagagggagggaaatttcaaaattactttagatgcaattagaagtaatcagcttcatgtcataaatttttgatgcaattggtcccttcctttctggattattttttctctcatgtccagatggttctcacaaacatatcagaagatgatgacatttttaatttctttcactcaagctctgaatttatctgaatggaaagtatagagaagagtgcgattcttcaagcctaacaagtatatcacactgattaaattatgaaattaagattttttaaattcaaaattaatgtataacttttatctacatatttgagatattcacaaagacaattttattgttccaatcaaaaattaattgtattaacattttattattcatgtatttatttatcctgagagtcttgctgtgttgcccaggccagagtacagtggggcaattttggctcactgcaacctccacctccctgggtcaagcaattctcctgcctcagcctcccacctagctgagattacaggcatgcaccaccatgctcagctaattgtagtatttttagtaaagacagggtttcgccatgttggccaggctggtctcaaactccaggcctcaagggatccactcaccttggcctccctaagtgctgggattacgggcatgcgccaccacacctggcctgtattagcattttagatgtaggaaatgatttttcagttctaaaattttcctaaagaattaaacatatccacttaaggatgcgttgaccactgatcattgttgaataatgaaactttagggatacttactggcacattcaagtgaaaatgttctacaattccctaggtagtatttcttttctctaactgagctgctgcgaggctcgcatagggtgaaagtaaggtaactgtaaaggatgtaccttgttatgggtcaggcagcaggttaccatattggcacatatagcaacacatgcatacagcagagatcagagaaagaaagtttgtaagaattcctaaaacaggatagctttctagtttctcaaatactgctttctgatttaaacaaatccaaaatacagttatagctaacgtcagagaaaggagttattaattcagctgtagaccattaaacaaacagaccccaggcttaggggcagatgggatgcttggagatgtggatgtggagagacaaaggcaatgccaagaggccagtgtgcttagagcctggcctccctggagtcctctgacagcaggtggatcccaatgaccctgtgctcctgaagggcagaaattcaattaggaactctcaactttcagctttgaggctcaggctagtgtatcagtgggtagctccactgctggaggaaaaacattctgcagcagttatgaaatagaggctaataataggacaagggagagtgaaaaacatgaggttggaaagcattggcagaaaagatgagctgataaagtatctactttaaataaggtcataattttgccacagtttggggtgttctcctgtgctaatttatagtcacaatcaaaatcacatggaagccttattttctttgacaaggttttattttcagtgcactagaaagctctttcctttctgcctgggttagcatatgtgaaagaaatagtgattattttaatgatattaaatagtagctttgatctcttccccctacaagctaaccaaaacattatctggatgtatgaaatgattcctttgtgagcaaaacctctgtatctattataatgtttttgttcatctacctgaatctcccactaggctttgagttcatctgtgcttccggaacctaccacctactcaggaaagataaactggatcaatgaaaaatacgctaaatacctaccactctcattttttagacgacaaatttgaggtgttaaaaatgagacagaaatgttaatatcaatcttctatttcaaacctactaagcccaaggcaaaagcttacaccctttctacactgcttcataattgcctaccttgtgttcatgttaaatatgcaaagaaacgttgtatccacatttgatacatgacaagaaggagactcccagagggaaggtcgcttcctcaaagacgcccaccagtaggtaggaggtctgatcgccagtctcagttctgcctgactctaaagctctcgatcctccaatcttgtcaaatttgctttattataagaatcaccaaaggccatggttataaatatagattctcaagatcttcctctgaagattctaatttaggtatcagctgggacccaataatcacgcattcattgttgagaccaatttgggaaacagtgaataagactagtgtttctcaaactctagtgagtgtatgaatcctgtggggatcaactgcagattacggtacagtggtaggtctggggtggggcctggggttctatgtttccaacaaggtcgcaagtgatgactgtgctgtgggtccacagccgcacttgaagcagtgaggaactaagccttgctgctcagctcacaataggacccttattcccaccctagaggtcctttagtaattctgccactaccacacaccctccaactctgtgcagcccagcaattatgccagagcaagctttcctgcatacccttgtaaacatgtttgtgaagcttatggaaacgtctgtttatctgtatgagttaccctgctagttcacatacctaccaaataagaatctctgggcacctgcgacacaacttcatcccatgcccatctcatccacgatggttttaaaagccaactgtttccacaggtttctattataacagggggattttatagatcacatttgctattcacaggtttagcctggacaactgatatttttcccaaacagtagaacttttaagttgggggaaaaatgttctctgcagcattcagataaatggatgaagaagcacttcttagaggttgccaatcatcacacctctgcaggacttaagttcatctaggataactcacccgaggctttaaaaaattactgatttttagctgggtgcggtggctcatgcctgtaatcccagcactttgggaggccgaggcgggcggatcacgaggtcaggagatggagaccatcctggctaacacggtaaaaccccgtctctattaaaaatacaaaaaattaaccgggcgtggtggcaggtgcctgtagtcccagctaccagggaggctgaggcaggagaatggcgtgaacctgggaggcggagcttgcagtgagctgagatcgtgccaccgcactccagcctgggcgacagagtgagactccatctcaaaaaaaaaaaaaaattactgatattttttataactaggaaagctgtaatgtgtaaacatgacaaaacgccaaaacgctaagtgaattttacaatggaacatggacttttcaaagggacgattctgattagtgaaatctgttctaaacctcggcttttctgattcctagcagggtgacccttggtaatatcttagctccagtggaccttaatttcttcattgtgaaatggcgtgattgaacataattcctaggtctcctcgaattctaaattcaggtgaagaaacagggtgatccgtcgcaatttcatctgtttcagtatatgcgtttatgacatttgtatcaaagaaaagtggagacatttcagaaacagcaagtatttcctgagaaaacatagctgttctatgtgttgaagcacaaaagataaaatgccaaattaagaagggtgtgactgtcaggggaaagacggcacacagaaaacctgttagtccttcatgccagtgcctcacagactggctatctactcacctgagcagcttttaaaaatccattctgtttcagtaggtctggggtggggatgaaattctgcatttctaacaagggtctgggttccaggggtgtcgctgaacgtgcgtctggccttatctagcaaggctttacaccggagctcttccactttagctgcagagttgaactggccagattcaacattcagatagcccgaacacatgcagagcaaacaaatttggatctctgtaagtgggactaaggcatttgtcttttaaagctgcctaagtgatttccatgggtagccctggttgagaatccctgctctactcttctgccacaggcctccactggggcttcccaggtccttgaaactttgggtttcgtttatttatgaacacatttatcacaatggtagaatacaaaataggtatttcaccctcactttaccataaccagtagagtgaaaccgactgtgccaagagatcatgctatttatctggtggggtcctttacacactcacagaattttccagaggtggtccttatgaagcagactgactttttattctgctccccaagcaccaatgctaccactaacaccgcttgtggcatatttccccatggctacatgggtctccataattgtcaccttcaagttacctgttaccatgctggtcaccatacccatgtttagtaaggttttccatggctgcatgtttacaagctttctgatcatctttcccttttccttctcatcctcactcttttcattctccctcttccttctatgcatattcattgagtacctgctctctgtctagcctatgctaggtgcttcattgcaatctgtacatggatgaagtacttatcttctactgcttctttggaattgaatactaagagtgaaattacttggtccaggaacatgaatatgttcatgactcttaacccaaatctctcttgcctgcattcggtaagcttctatttgctgattgaatatgtgtaagcttgcccctccttattatttaatgcttatgtctttgattgatgtatattttttatattctttatttggctgtaatgtgaatttaaattttacttttttctttaatagtgaatgctttaaaggcaatgagaaaccaataaagaatattaagcgatcgaataacttgctcattttatgcatgtgtcatatattttcatcttcagaagctaccagttcattctctgtataggcagggacaacaaggatgcctcgcagtaaatattctttgatttcaccagagcctcttagctttgcaaatatgagacatacatgcatcatggtcctgcaggatgagggtaagtaatctgagagaaagagagagagaggtgtatgtgtgtgtgtgcgcgtgtgtgtgtgtgtgtgtgtgtgcgcgagcgcacatgcgtgagttcatcagcctgcccgacaagggataacgtaacataatactcaagttctgggagggtagagaccaagactctaaaccgtgtccttccaaattcaaagccaacaggacttgtttgagaagagcagtgaccttattgagatcaatggcaggaagggacaccaagagcacaaaggggaaatgactaggagaccaggaaggagtcagatggtgacccaggcttaaatctaaacctagagaacagtcatggtgtgtctgtattgtcacatggtgaaagtgaatcaggctttcctggcttccctgctttgggcttttgagggtgtgtcgtataatcctgggaggctgggatttctgcaaataacgtttacaaatcaggttggattgggatttttggaggattaccacttctgtcactggtgccaccttgtggcaaatgctacagtaaaaacttgctgtagtgtaaccgatagaatttgaccatcatttcttttactaggcgtttgggctaggaagtgagaacaaatctaatatttggataaccagtgaaggggaaatcttgagctttcagtcactaaggataggtggaggttttagaactctcttaaattatttatacaggattgtttcgtttgttttttcttacttgttcagggagatctgaatagttgtaggggagagaatgaattggaggagtttctacctaaatgttaaacctcctccacactccccaacatcaacctggaaaagttacagagggaaagcattaagacatggaaaacattctgagaaactccagtgaaatacgtctgtgggagacaggaactgttgtgaacttggagtacgtgtgatttgaagcctagagcaggaggcagctcatggggctctggagctctggctctaagccagcaaagactgattcactttcaccatgtggcaatgcagaagcagctgggttgttctccaagttgtagatttaagcctggatccctgtaacttagggaaagagttgatggaattttctttctttgcttctttccttccttccttccctccattcctccctccctctcttctcttctactctcttctcttttttcttttcttttctttctttttgacagagttttgctctgttgcccaggctggagtgcggtggtgcgatcttggctcactgcaacctccacctcctgggttcaagcgattctcctgtctcagcctcccaagtagctgggattacaggtgtgtgccaccacacctggctaatttttgtattttttatagagacggggtttcatcatattggtcaggctggtctcaaactccagacctcaggtgatccacccacctcggcctcccaaagtgctgggattacaggcatgagccgccgcgcctggctgctgatggaattttctcttgcttctctccttctatggcctggtgtgctatatcactcacactagggaggctcagactataaggataagagcactagaagatctgagtagtattcgtggatggagagcagaggggacacaggtgggagctaattgggcgcaggcagccatttccccatccttctttctccaaatcctgataagtgatggactgcacccaaaggagtgtttcttcctcaggatgttccccctgggagattgaacatgaagcctggacctaagaaatggtttggtagtgttgagaggggttaactgtggcttcctggcacctgtgactctcacttcaagctcatcccatttccactctaacaccgtaggaggactgcaagtctaacgaagtctagccatggccccttttacattttcattgcctgaaaaattagccaacgcttggggggaaatgagcttcacaggcccaaataatgacagaggagcagcactatttcaaaagaacatgaattagagaaaatctttagaccaaggaaaggaaacagagacaatgatctaaagaagcgagaattgaaagagagaatactagatagatttgaaaaagataatccacagtaaaatgggtgcgataataacaatccttgctttactggactattatgaggattaaatgaattgatatatgcggtgcataggctataaagtgtttaaacatggagtataataaatattcactcttatgaaattttatattttgactcaaatgtagaatttggggaagaaggactctggtttaatatattgagtgtgaagttctaattggacattagtatctttgtatatatgtatattacatttgaagctcaatgtaaactgggccagaagtataaaaccagtggtttggcataaactgtctctgacattgtaggagaaaacttcaagtggaatggaagccttaacagtgatgtttgtagggcataaaaaaaaaggtttcctgaagaaaggtaggcagattcaacaaaatgaacaatccaaaaaaaaaaaaaaagaaaaaaaggaaaaacaaaaaagccacaaattcaactacttttataatattctcaaatgcaattttataatattcaatattaaattgtgtgaaataggagagcaaaagttttgttgccattcctcaatcctcctcaccaaggtttaaccacagtttgttggatatttaccctcagttctttttttatgtctaaaaaaaagacatgttttactcagtgtacatgtggagctttttacttatggcttcagggatctaactcatttcttaaaatgactatgttgcattccaaggatgaaaatacacactatttctaactatttttctatagacaagcagatcagattttttttgcaattaacgctgtagtaaaacttttaaaaatacgtattactcttgagttattggaacttattcacaaaaaaggtaattaagttccagttaaccagtatgtatagattctataatctgcccagaaacatgctaagtactgtatataaagcatcattgtgaaagataaaggcagtgagtattttaagaagaaggagtgattagcaatgtcaaacgcagcaatccagtagaaatacccatggatttagcaagaagtcaattgagataaaaataagagctatttgaattgtactatgtagtaagatggcagatttcaattagttaaggtgtcattagagatgggaaagtatagaaatgagtacagattaacactgaaacaaattatcttcatatacctatttgacgggaaaaacatatttttgagggattctagtagaagtgtacattggtataacaactttggaaaacagtttgttattaccaccagtcacattgcacatgtacctacactgtaactaatcacttcctctcccagagaaattcttaatattaacactccagaagacatggacaagaattcctagaataaattttgtaataacccctaatggaaacagccagattttcattaatagtagaatggcagcggattacattcatacaatggaatgccatccagcaatgctaatacctacaggtaaccacatggatgaaccacagaggtataatattaaatgcaaaaagcaagatttgtaagaagatgcagtatgatttctgttagacaaagttaaaaggcaagcagacaaaatggaatattgtaaaataataaatagcagcaagggaaccgtcatcaaaaaaggcaggttaatagttggtgttttgggggaaggaagaagattccatcaattaaagatgcatagagggctcctgaatccagcatgtttcattttctgacacagcggtttttgtatgtaatggtgatgttaatgatgataatgattaaagatcttctttaagaatggaatatgttgtaatggaaaacgacaacattacagagataacaataactaacatctattgatccttttgtattctggacactattctgaatgcttatttaatccttataaaaatcctttaagataaacatagctatcataccccattttatagtagaagaagctgagatacaaagcagttaagtaactcgtccaagcggcagagcaagaaggcgatcagcctccagagcttagattctcaacaacgtgtacaagattacctctgaaagactgaaaagctatttcatttgtgctttgatttttatatctaggtaactttgtagtcaatattttactctatttgtgagatttatatcttaataaacttttctcatattttattttatcacttatgcttcatgggttgggagactttatcacactaaatgagacacctttgagagtaagatgctataaacaatactcttggaaaacaagcataagctgggactgtcctggacaaactggaacacatggtcacctttcatagcaagaaggtgataatgcagcaaggccactactgatgaattctttcctttcttgtgttaacgtgttgcttatcacgtgagtttttgtatgtgtgtgtacttatgaacattctctttagtttggtttaaaccatatttgctcttttatgccatttcatattgctttaattaactttacttttaggagattttaattcctagcagtataagttctttttcttcactgttacactttatccaaatataatttgataatttaaaaatttttaaaaacatattttcctgttttataattgttttatttgtattacctttatagaaatacaattttattatgtttatagagtgcacatggaaaagaaaaatttgcagcccatgggatcattactattaattgctttgccttccagtcttggccagaaatattcatctttataatatttcattttatccttctcatatgtagtatttctgtgcatttattcaaatgtttttataatacttcctttagtagcttataggtttttatggactcattcaaatcccttaataattattttatcaggaatcttctcattgcttaactagtatgtgataactagttaagcacaaatttgtgttttataatgataaaggaaaggcacaaatttttgtatttttatttatatctagttaccttatgtactaaacatttttgttaggtagattttgaattgtctgccttttgcaggcctgtaatcctgcaatataaaaatagtgcatctttgtttcatagacttttgttaattttttaaaaatccagttctcacatactattttattgatccagcagtcgaaaccgatattaaatatgttaaagcttattaaaggtcccattattgtatataagactgtaaagtagttatctgtacattttatacataatgcatatgtataaatatattttaggcatagacataaatttctgcatagtcctttttatcaaaacccattcaatggagtactttattctcattaagctattcatatggtgtattaaactaatagttttgcctgtatagaaatattcttgaattcataggatgaatttaatcctactgcttaattgcaacctctaataatgtacttaagactttaatttaatattcattagtgagattggcctggcctaattcttattaaagctttattacattagatatcagttggcttttatttcacggaataccttcaaaaaggccttcatttattcattacatattctggcaatttgtgtaacactggtattaaagtttgtttatattttaaatgaattttccaataaatgaatccaccatatttgttttcggtagggtaattttttgacagcttcccaattctcatctctgctaacatttttcttttctataattcaggactgcattgtacatttatgtaatttttttcataaaatcaaaatttgtttatatcttctctctcttaaatgtttaagattttctgtccccaaatgagtgcatttagtaggctgttgcacatactatcagaaattccatgaattcatacctaaatttatttacttatttaaacaatttatgtttttccttttttaaaaaaaacacattttctttagcattgactcatttttgtgtaatttttggttaaattaggttacatgttttgtttgcttttacatttttaataatgaaagtacttaacaccatgattgtttttgctgagtgtgtataattgcttagttggttgttttaatagaattgttactatgtttttatttattttctccttcactcaattgttatttggtaaagagattaaaaatataaaagaggggattactatttaaatttttatctcaaagtttatgttacagtaatctgacattgtgatctgtaagcatagagactgcatttatacatctctacagctaaatttactgattttagaatgaggaagaattttcacaatggttaaataaatgataatttttctaaatgttttattaaaaactcaatgttcacagatacaaaattcaaactcttactatttaattatcctggttaaatatgtttctcattcttttatgtctttttatttttatcaagtggatgtgtttatgataatttatcttctcctatacttaaatattttaaaaacaattttactgcatcactaaacattaatctgctattcctttcaaatgaaacctttttgacagataattttgaatataattttatcactttttaaactgtcattattaattcacttaataccttaataccattatattaatattgacaaacttatttaattttattcacatttgagtcatctgatttttttctccatttgaaaaatgtctttaagttgtttgggtttttctttttctctaaatgcaaaacttgaaactataaaactttattttagtttttttttattttcaacttttattgtaaattcagaggtacatgtgcaggatgttacataggtaaaaatgttacatatgtaaaaatgtgccatggtggtttgctgcacagatcatcccgtcacccagaatccattagctattcttcctgatcctcttgatcctcccaacccccaccctctgacaggcccaagtgtgtgttattcccctcatgtgtccatgtgttattatcatttagttcccacttataagttagaatatgcagtatttggttttctgtttctgcattcgtctgctaagggtaatggcctccagttgcacacatgtccctgcagagaaaatgatctcattcctttttatggctgtatagtattccatggtgtatatgtgccacattttctttatatagtctatcattgatggtcatttaggttgattccatgtgtttgttattgtgagtagtgatgccatgaaaatacacatgcttgtgtctttataatagaaagatttatattcctttgggtatatacccagtaatgggattgtgggttgaatgatatttctgcctctaggtctttgaggaattgccatactgtcttccacaatggttgaactaatttacactcccaccaacagtgtaaaaacattaatttttctccacaacctcgccaacatctgttgttttttgccttcttaataaaaccattctccagcatctgttgtttttgcctttttaataaaaccattctaactggtatgaaatggtatctcattgtgatttgatttgcatttctttaatgatcagtgatgttgagctttttatttatgtttgttggccacatgtatgtcttcttttgcgaaatgtctgttcatgtcctttgcccacattttaaaggggttatttttttcttgctaatttgttaagttttttatagatattgtacgttagatctttgtcacatgcatactttgcaaagttttctcccgttctgtttctgtaggttgtttgtttacattgttgatagcttcttttgctgtgcagaagctctttagttttttcattatatatttagatttattgactgtatttattatacctattttcttctcagacaatcaagaataacaataatagctacaaagttctcttggaggaaagatataaaaaatacttcttgagcaaatattgtgccattaatatgcaaagtgtatagaatgatattcactggtaggcaggtctcaaatggtgtggagcaagcaccttttccaaaacatttctcatggtttttcttcttcactgagattgaattagattaagcgtaattaaaaatggagagactctatacaaggaataaggagggcaatattttataggtaagtatgcgagagtatatgaaattggggatttttgctataaagaggggattgttgctatagacagtaaattgatatgattttagatacaattataggatacaaattttgtttacaaatatttagtaaggtgtgtttataaaatgggttgtcctgctgaaaattgtaaaggggcaagaggtatagtgaaaaagaaaaataaaggcaaaagccaagcataatgttttagctattaaaccacatttctgcttttcatgttgtcttaaagtgagcatatattcattcttgcaattaggagtatttgattgtaaaactgctaaatacaaaaaaataaaacagataaatatagagtaatgctagcaagtagtaattcagttgaaggaaaaaaaatcacatcagtgaaatcacttttccatgaggcttttccatcaaatataaatttttatatagtttaagcacatttgtttacttttattcctcattattctaccctctctggtctagaataagtctaacatgggcatttttaaaaggccatacatatttaaacgaaaatgaaaagattaataactgtgcaagtattgaaactttaattatataaattctcaggcatgaaagtgttctttggcatttggctgtatgtaccattacttgtaatatggctccttattaaaagtcttttttatgcaagaagataaataatacaaacatcaacaatagagtggcatgggtttatttagatattaaactgttaattatgtatttgtcaaaaatcataaatcaggacaagttgagctggagaatgaaatattcagcctaggtctcattgtcatcataaattcctaattttggtttaaattaaggtatggacaagagtcttcatagaaacattttcaactcttctcttcttattcctttctcattttctctaaagaaatcttatcgaacatttaatctcaaaggtcatgaaaaagtatgattgacccatattgaagatatttttactactttcctttatactcggaaagatccactttttcagagacacattaaaaataactacccactaatatgtcttatcaaattacttcttggaggctgttattctaaacacaggagttagttcagtcttggcaggttttctttttctcttctttttatttatttatttatttatttttgagatggaggcctgctctgtcgcccaggctggagtgcagtggcatgatctcagctcactgcaacctcctcctcccgggttcaagctattctcctgcctcagcctctggagtagctgggtttacaggcacacagtaacacgcccagctaatttttgtatttttagtagatatgggatctcaccatgttggccaggttggtctcgaactcctgacttcaagtgatctgcccgccttggcctcacaaagtgctgggattataggcgtaagccaccgcacccagccttgacaggcttttccaatacaccatgtcatatttcatttttgccaattatgttacatgctttagctttattttatttttttctttttcttatggaaaatggaaacagaactgcttttacttttaaacttatattggcttgttttaactcctcttatgttttatcataaaacactcaaaatatatatgcttttaattccaatccgctcattgtcttaaattgtattttcaaggaaagaatggaatgcacacaactgctttgattgtcatttctatttccagttactcatgtaatggcactgccaggctggttggttggcattgtcttaggtgacgcatggaccatttcccctgtcttccagctgtgggcgttataacattcttgtttttcagaatgccagtgaatgtaccctaacaaacaagaaaaggaaagactgaccaaatctgaacattttttagctggaaaacatgtaaatttaatacttttaatagatgaaccctcatgttagcatgcaaattagctgttcctaccaagtcaattggaatgtgacagttaattctatacatgcatcagcaatgacctcagaattggctgtccatcaacttccatggctatgaactcacccaccatctttgttctagaaagactttccattaaaaatgtaagttcatgattaaatcaaaataagataaggggattattttaacattaatataacaccagaaattacatttgtttctgtggaggaatgctctgtttgctttggaaagaatgcagatccttttcatttatacagagataatatatatttttaacctgtcagaatggcaaagaacaaagttggatagcatgttgttgatgagcaggtgggagcatacatatatgtataagtataaattgctacaatgaagggcaatctgtttctaaattagaaaagtactgatcctgtgacccagaaatttcatttctaagattagatcttacatatatcctagtatcataaaaatgattccacaacacaattactcatcacttcactgaaacaacaaaatattggcaacaattgctcatcaacaagagattcattaaaaaacattatgggactctcatgtgggatataataatgtgctgtaaaaagggaataagaaagtttttttatgaacaaatgtggacccatttgctgagattattttaaatcaaaggaaaccaaggtaaaatgtaactatttacgtaaaaagagaatgtatttgcttgtgtatggattttatatatgaatgatatctctaaaattacatctgagaaactagaagtattggtgactagtggagaaggaaaataggtggctgtgatcaagatgtgagacaggtaatttgctatagaaccctggatttccctttaaaaataataaaattaatttaagatcatgtaatatggtaaatatttggactgctgatacttctttaaaaatcagtaaactttgaattgtgtacatttataacaaacatcctggcctctaaatatgtgaagaagtgcagaaatcatatcagtggtaaaaaaggaattagtacaagatttcatcttagagcatccagactctaaattgatagatatgtaagaatgaaagtttatttaaagtggaataatgtatacctcttcctgtgtccccaagatggcatcatctttctaacattgattcagcttgggcttgagtgtctgagctgtgtctcacaaactaagctctccataccatcggcatcaaagtcatttgctggagtgtgttaaaataaatattttcgaattctatcccatacctgccgagtcagtgggccttggaaaggagcccgggaatctgcattttacaaaagatcctcaggttagtcttaaaccaagattctagaaccactgttgtaaagcctggggaatagagaggagaaaatactagaactactcattaactggttagcacatgatggcatcttcttacaaacctttgtgtgcattcacccccctaaccacaaagcaaaatgagcatcagaaccttcatttaaagacaggaaaattaagtatttgtctttgtgtaattaagtgacttgccacaggtgacagagcgagagaatgcaaatcagaattcaactcgcaaatttctgctttgtccatgctgacaggaatagcatcattgtaaataaaaatcactgtgttagtgtaactttgaaaagtcaatccctcagtaaaccttgctctgcagtggaaggtcatgcctttctcagcctttcactacctaggattcacaggagatcaaatactttgctaaaaagagattttcttattttacttcacattctcatatctttatgcattactctcatttattcttcagagaacattctgctcagattaacttctgtaagcaacaagtatcccacatatattttcaacggccagctagctattcttaacaggaagaaaaaaatacaaacattggtgtgtactttttatatggcagtagacaaacgagggtaactggtgaatatataagttaatattctgaattaataaaatgaagacacattttgaaatcaacattacaggtaatatccaataaatagctttatacatatacacacactcatacatgtatatatgggtagtttctggacttaaaatagattcaaaaaagtttccattatgtaccagaacaatagctggtcttagggagatgagaacacatgtagagtctgactttatgaagtcattgacattaacacgtatgataactctcaattgtgaaagttaattctgtcagaaatgctgtgtgacaggcctattagagcggctacttgggccatttattgtactgtggcctatttccgacaagtcagataaaccatggtttgaatctccactcagtcaaaactgcagctagtcacttaaccacactggtgttcaatttactgtctgtgtagtgaattgaacatacctacctcaatgcgtttttatgggaataaaacaagagtacaaacctatctgtccactagtggtattttttaccttaagtcacattccttcaccactaatagtggttaagttttctgactctcagtgatccattttcaaaaggccatctctgaaatttttgcctctactttctttaatggcatttccctatgtcactgcttaggtgatatgatttaggggaaagccatattttacttgagttaaagtcaagtttgtttgtgtttttttgtgggggggctggggtggattgttctcaaaatgatttactgacattctccagcataagttttaggtgaaagagtattctcaggtgggaaatttgagtaaatcttgaggaagaagtatattctttacaaatcatttagggaaaattctctttaaatagggggacctacttatgcatctgatttgcccgtgacactcattgtttacactttcacacctacataattattaataatgctcttttactttcaaaaatgtgtagtttgaataaggtgtatgaaccacctaattgaagaaagttacttgtcttaacctagaggttagctagctagcatcaagagtttaggggaccaaaaatggtaactctctaggaaataaaaagaggaattcatctacttctctgcagaagaggactggtaaatggactaactttgcattcaggttgtaattagacaaaacagaaagtgtgatcaataatgcaagtgcatagtggcagaagagagcatggtgaagtgagcctgtagacacacttgtgcaatatggggacagctctgatgtggcctgggctgtggaattcagtttagggggaagtgggttgggagtagtggtaaagatgaagtgagtggattgggccctggcttccggattacaaatgtacttttggaaaaacaagattttgaatagtgtgggtgtctatgtaattactaaacaaggacattttttagcttttggctcaagtgacaaagattttcctttcaaaagcattttgccagattgaaatctaaacataaacgtatgacaacattgctaccggtagctaattcagtgattcaacatgtctgtttatcaaacacttgagagcactttcaaagagccctggtttgggtatgaggtagagttttgtgaggcttcttttaaagcctctctgtctgagaaggaatatgctacttttcataccaccttgccagaaaggaaggcccagaacagaaagaacacaaaagaggtataaggggttaagggaacctggaaaaacctttgaaaagtaaattatcagtttagaaatgctctttaaatgtcaacaaagagtcagcaggcagtgtgtcagctctgcacctggccacatttcctatcctctgttgcaacttagtgaagctacgtggccaaactagagccaacggaacataagtgggagtgatatatgtaatttgggggcattttccacataaaataaaagctctttgccatggaatccctttgtctttccccttcccatgtgtggtcacaggaatgactatgacccaccttccaatcatgcagatgaggataatgcccaaggggataaacttttggggaaaaaatgagtccactcaccaatccatatttaaagacttatatgtgtggaagaaataagcttttgtgtgttttttagtcactctccttcagtctctatactacagcagttgaaatagaccttacataatacacaccctttctaggtacctacaggtcttctgcaaaagcagccatacaatcttcagattgtgaccaagttgcttttaaaattctcatccaggttgcctcttttttctctctcttggttgtagcaattctcatcagtagtgctgccaaagttgaatcctctttcgagcacatgcaaaaaaaaaaaaaaaaacaaaaaaaaaacccacgaaactaggaaaagcattagaattgccccatgtgaattccactcacatttcaaagccaatacatgtaaaagattaaatgaaaatatcccatctactgttatcacactctgctgtcttcaccaatgtgaactgagaataagagatggcagcttttcaatgtattgcctagattcctctggcttgtagtgctcccgtcatttctatttcctaccatgcttctgtgataaagcgagaaataatatgccaaaatgccactagcattcaatacagggtatgctgtcctctacaattagcatatttttttctgatagaccaagtgtttaggatgcaatgatttataggtccaggaaatatatagacagttgcttggatgaaagaagggtatgtaggaagttgactttgtgtactaataaatgccaaaaggtacattaggttaaggaaattatgtatgaaggagtctggcgataaattactgttgcatttttctgagttgaattgcttatgtgtctgtataaattgctaagcagaaaataggctaagagcattaaaactttagttaactcttatttcctcaggtctatgtaattttaaacttatttaggacaatagcccatttgttttacaaatcacagtgttcattgcaatatctttcaagctgaaagcactaaatcactttatattatggagacctggaagaatgcagcattatagcttggctggcagaacatgtatcagtgagatattgatctaaccaggaaaaagaaaagctgtgctgaatggactccacactgcaaggagtgttatctgcaggctgcagtgtttgttcaaatcccatattgctggaggtgaggtcatatatatatatatatatattttttgcaggcttcatatgattttagtgacagttatggccattttcttaatctgaaagattaagaaagttgtttgttgaagaatgtctgtagataattccttgacatcaggagtagctcacctttctgcaggaatgggttaaaatggaatgttgatcaaatgctctgacttcttaagtatggtttgtctatacttccaaacctgtatcacagaacccctctggaccctttggcaattcaaagtatcaacactgagacaaaggtgtagctgtcagtcggaggggatattgtgtagttgccttaagtagtgttttcctagaagacccctcagaagtaaagaaactgaaacagaagtaagacatgagtcttaattggattatgctgagattaggatactgtgtggctctgacttctcatctcactttcaaagaccgaggagacaggtgcatccgtaatttgcatggggtccaggaaggagccctgtgggaaagactcagctctgtgtacagttagcattaggctgttccaatatgactgattgacatggactgactgacagaaaggattaaagtcctggaaagagaacaacagaagtcattgccaggagggaatgaaatactgtaaggaagttaggaatctgccatgctgaggataaggaaatagagagctgtgtttgaacccatcttcattttgtcccttaggaatgcatgtgctatctggaaggataaactagaataatcatatcaccagaaacataagtgagtcagctgttcgattcactcctactaccaagagtagacctctagaggagcagcatatgcatggcaactagacctctgctcctggcgtagatgtgggcccctggtcagttttcataagtgcttattaaaagaataatggaatggtcatcagcaagctcctgttagggatccacttactgtcctgctggtacctgtgcactctatgataattcatatttggaactgttttattccctttattgtatgcagagggtattttgtgtggtcagagattcttccatgtgcctgccaagtgattattcacctttttattccaatatcctatgtataattgcacctacacactcccatacaaatcctaatgcagtgtataggctgtgtattgctatttagtatgctttgtctccagttgtgtctctgagcccaggtccccctccataacatcacactgtgctatttctccaacatgctggcagacacagagctaacaggaagcctaaacagagcatttccctttgggttgagcgtgagggggcttcttcttcctctctcatgtcacactctgcttggcatgctctccagtcctctaaggaacagatgcaggagcacatttacaaagcaggactacgatgagcgggcacccgcgaggcttgagatgtgcccagcctcctccctaggcaggctgccaaagcaaagctccctcatgtaatagcttgggcagataatgggtagacacaggaggaacaaatcaggaagcaaactcactgtgggcctgattcccatttagagggtgagacatccacagtctgggatagtgagaaatttatggaatgggctcttttttccatttctactctcttctttgctgtggttcctcaaacaccacttggtgcacagagctagggaaaagcaacagagcttctgaaatggcatttggctaaaacacccagccaatcttctatttttatttaattttcatatcagcagtattttattaaaaccattagtaaaatacagagaatatctaattttagaatgacagcattcaaaccatccgttacaaattgattttaattaatgtggtttgtcataattaataggttattttgactctccacagtagccttcatagtggtagatgaggacctgaggtcctctctcccacagctttgcaactgccaggtgttacattacaatggaagtaagtcttagcttgaactcttctgtgctgctgtggaatgaattatcggtctcaattcatcccttcccagtagtattaagcacaacctagccatgcttcatagtgggtccacaatttccccactttttgatttggggttcagatgtgtaacttgctttggtcaatggggagtctgcagataattggaagtagaggcctgaaatgggctcatgaattggaattgctttctcagtttctgtcaccaccatgagaagaacgtatgccagatagctgctgccaattcattgaaatgagaccctcaaagtacaacgcgtaaatgcaagatcagctgaaattcagctagcccacaattccctaagtcatgggaaatatggtgtaggtcactgatatatcaagcttgttgcacgttattgtggtaatagttaattgacgtacatatataccaacacataccagcaagtaagcacacagaaaattatacaaccaattctttcaggcactccaccaagcacattgcagatgtgaaaatatgatcagggcaggattctgctcacctgattgaaattcagggatagatccctcccttagtagactgtccatatgtcaggtacacacagctgggataatacctttatcctagttgtgtaaaaccagaataaataatatggacttatagtttatctgatctaggccgaagtcttttaaagtaaattatagacaatatggcattatatatctgtctatcttatcatctactcatccttccatcattcatccatccatctatccatttatccatccatccatcatccatccattcatcatccatccactcatccacccatccatccatctatccacccattcatccacttatgaatccaggcactgttgctttccacagtcatgtgggaatgtaaacatgaccaattaaagctgagtcagtgcaatgtgattttaataataaataggagaaattattattgccccatgacctttaaacatttttgtcaaaacattgaaaatgctcttaccattagatatagagaaataaaaaaatagaaagactaatatttatttagtaaaatgtaatttaagatactagaaacattaagaatttaagtattttatttctttattaaaatcttatcaggagcggtttgaacagggcttggctttttctcatggttatgtaatctgtagtatggagggaatgagttttttaagccttggcaaattgccatactcctttcaaagactggatgagtttccaatatcttatccttttgagattttcatggtgtgaaatatccccaagagttttcttaatgtgaagatttttttgctgtcctccctcgctgcctctggaacattttttttcatccttcttgtcactaccactttccatatttatatcaataactttccctttactaagttcctctagctgcataatggaagctcccaaatggcagaagtgccaatatttccaaggtcacctagtgctcctataatttcatttacatttaattcaaattccacttccagatttattactctttgtttctttgttgttctttcatctttattgaccagttccctttttcaattgtccatttgataaatgagtttatccctgggggaaaagggggcaacacagctacacacttgccgtctactcatgaacaaatatatgcacagcaaccaatcgctgactgacttagaaagaagtgatgtgattggtcattggtcatgaatctgttatttacatagtgatttgttgactgaagagctagcaaagaagtttgtagcttatgtaattacttgcaattaaggtaatggagtaacttaaatttgaactgtgttgttgggtgactggtgttatttaattaaactgtgctcagtgaggactgaccatatttatttgtccctctctcactctgtgtgtgtgtgtgtgcatgtggttaaactatggatttctaagtcttttttcctataaaggtaatagcaatgctttatagctgctggatatggtcacttaaagaatttgctatcaaccccttagaatctgttatcaaccctttagaatctgtagtctctgtttccaaatcacaggctctgtaacttttctcattcttgtctttctgtgagtctccaatgtcaggagaactgcctctcctgtgagctttgtgccttcctgttgtgtctgtcatccttctccccagcatggggcaattggtgtccctctgggagttttcagatagtaatttgcccatcttggaaggaaatggtctccctttggcctccttacttttctcagggtgtctgttctcttcttgcaaatgtctagactcctaagactattgcctccacagcctggaacttttaatgctaatattgtataatctggtttgccagacctcatgcctggtttagaatgctcatcgggaagaaaaaggtgctcccaaattatgtggataatcttgaagttgaattattatttagaatacaaaatgtatacattgaaaagcaaactcatcttgtaaggaaaggaaacatttgcatttcatagtgagaacatggtttgtctaagcaagaaataaaattaaacatagtgagccaattaggaagaaatgatctgaatatgtatcattgtgacaatattaactcatgacaatttctgcttgtcccattcagtatcttttagacatttctaatctagagtcagtgcaaaagccactggccagcttctaaatgccagggttttaaatgcctgtcaaaaatgaatttgttaccttattttttacaaggacactttgtaatgcaaaagggcaaaataccatactctcccaggaaatatgtggtaaggaggctaaaccaatatttttctttttaagatagataacatccctcttcacaaagagaaaagagtaactgttgtctcctctaaactatctttcagacgtttaatgagagccatcttatcccagcgagtaaaaggcaaataccagctgcctcctgagagaggggcaaagaaaggtcaaggaagacctcctgctgctggctttgggggcatctgctgtttttctcacccacaaagggcagtctgtctttgagcacttacagtgtatgcaaggagagtagcccagttctgacctgtcaatcactaggttagactctctctgaaactctcctttaggcaatggcatctaatctatgcaacagtcagagtgccagacacccagggcttgggctaggcttgcagggctcgctggagtggcccttggatcttagaactaacagaatcaagggaagtgggaaagccaaggccagactcagcagcagtagtcctgtgaaagagctagactatggggagagaaaccaaataggagctaacaggtcagctgtggacagcaagagaaagagagaggttttggaatgaagggaagtgattacaatctaggaaggttactgaaaacccagggcttgtttttcaataccttttgttaggtcaatatagcctctcccaaattttaaaaggagttttgaagagggctaagctaatttgaacaagtgagatcaaacaactttggttccaactgggatcttctagtcatcttggcttcgtgtatgtgtgtgtgtgtgtgtgtgtgtgtgtgtgtgtgtgagagagagagagagagagtatgagtgtgtgcctggcaacggtgaaatcagtaagaggttaacaagttcttttgtttccccagttgaatttaggcatagtaagtaaacaaaccgacattttaacatgtgcttcagaaaacgggaaaggtaaaagtcacttccaaaaggcccaagaaatgtgcacatttatagcaaagcaagggtgagtggaatttgagtacataatatagagaagcaaacctatggtagtaccaaaaattccgccagtgatcattcctgggcttcaggacctgccatgatgccctggaaatgaggcagaaggaatcagcttgagctgcttttccgacttgatgaaggcattcctcctactgcaagtttctcacccccacttaagtacagaaggaagcaggatacaccaattgcttagagtatttccaaaggatttaatgcaagactgtattgaaatatgctttaacaacttctacaatttctgagactatgacaagtgatagttaattttgacattgctgactgtggctgccatttattcttagcacagttattcattgtactatctggaatacatgcctcctttttagttaaattagaatcatgataattaacaaatatttttcattgaaaaagtacattcacctaataagcaaagaaacataaaagaccaaaatgactactgctatgatgaaagacaggataatttttttatttgttctagacgtaccaaatagaagggaattacaccaactcaaacccagggcacatgtaaataaataaaagtataatacaaaatatctttcttaagatgtcagaagaaaatttagctattctgaaactcaacagcagaaactgttgtatttcccatactaggagtatcaataggcaagtgtcttagttcgagctgctatctcagaatattatgcattgggtagttgatgaacaatagaaatttatttctcacagttctggagagtggatccctgagatcagggtgcctacatggcctggttctggtgagggtcctcctccaggttgcagactgccaacttctagttgtgtcttcactgggcagaaagataaatgtctaaatcccttcctcttcttaaaaagacactaatcctatcatagggggtttacccacaaaagcttcgcctcttagtaccatctaattgggggttagagtttcaacatattaattttgaggggacacaaatatgcaatctataacagcaaggcattgagagtggagatttatatgagccaaagcagaatcacagacaaatcatcaacatggttgttggcacataggcatttgctaattgtttcctttatttaatttagcatttggaaatatataaatttatctacagaaataggattatggaggcatctaaaactcctctgttgtacttctatgccattcaacaaatacctgctctctgaaagccttcaaattgatgtctgcccttaagggagatgaatgggagaagataactagcagtgagcaaacactatatctgatcgtttacagatattaaataatttaatcgctagaaaaagaaagcaaagcatagataacatatataattatcccacttttagagatgcagttcagagaatttaagtgataaaattatctagtaataaacagcattgtcagtaatgttagtaataaaatctgaaaatactaccacttatcaaccacacaccacgcagaaggacctgggctaagcactagatgtatattttatcctctcagcatccctgggtgttggctactgttatttaaattgcataggtgagaatatgaatggttcctaagaactgtgcttctcaaaattttatctacatacaaataaactactgatcttgttaaaatgcagcttcagattcactaggtctaggtagaacctgaggttctctgtttttaacaagcttcagatgacacacatgctgctgatccatggatcaaacagaaaagctggggttgagaggtgaagtaactcggtcaagtacatgaggcagattctttttttttttttttgagacagagtcttgctctgttgcccagtctggagtgcagtggtgtgatcataattcactgcaacctcaaactcctgggctcaggtgattctccctcctcagcctcctgagtagctaggacaataggcatgcaccaccacacctggctaattttttttaattttatttttaatagagatgaggtcttgctatgttgcccaagctggcctgaaactgctgagctcaagccatcctgctgcctcaggctgccaaagtactggaattaaccagcatgagccaccatgcctggcccagattgactctcagtggagaaaagatcaaactgttatttgtttagttcaaaattgcaagtgcatcttgccaccctgtgctatctcttccttgggtttggcaattcagcttagtggggagaatgagatgtgcacaaggatgactatgagactcagtactaatggcaacacactctcagacagaggcaaagaattccaccaccgtctctgccactcagggcttcctggaatgcagaatatctatgagtaattccaaatggataaatgaggatgattcccaaaaagaggtgtctggtaagctaaacctagaagactgaagaagattttacacataaacacataagaatgtatatgtgcatgtatttatatatgttatattgtatacatatgcaatataaatctataatatacaaaatttatacatacacatgtatatgggtgtgtagctatatataatgtatgtatataaattatatgtatatatgaatatgtatgtgtatattcacacacacattatatatagacacacacatatacatatattttgatatctatcttttgcttctagatagagagaagtatgcacagattctatacagtatgaggcaggatcacaggacagcttggtattttgaatgtactttgattccacagatcatgtagatcacacagtattttctcttcccttctcttacatgaggggcacccggatataggacacttagagtagcttattgatttgcttctctacttgttagtaaaatttttaataataggggctatggaattcttgatcttagaatacctagggccctagatcttgtcaattcacaaaaataattcatttgaattatttgatgttcttatttcagttttatttgaattaaattgcttttgatatttgcctttagtaattcaacctcattttcttaagatttataaagtttttatttggcattaatttggaaaatcagatatcgtaattaatttaaagtcatagaaaataaaaatatgagagcacctagaagtttgtaagatgatgttctattgctttattggctttactcagttatttaaaacaaagtttatatgcaataaaattagtataaaatccaactgatattgagaaatatcaacagtaattaatcaaattaggtttctatgataaaacctcattattaaatttgattttatttatgttgacattttctaagaaacatctttagaaagaaagcatttgaaatcttctgattataaatatttagcctcttatgttatcataagaggcatatctattttaaagaagccactgagaagctgtacattaattaagaatactatttattaagaataaatagtcatagaaataagggtgctggtagttatgattccccaaatagaatgtcacttctgttaaccacaatattcagccatgaaccttctgaaatttcaggccaagaagaaaataaagtcatgtctatagctgtgcctagttagtaatcagaaggttgagtttgggggaaaaaacaagcttttctccttttctaaccaaagaagttgtttttatttggtgtttgtttatttattttcagctgttgctcaagcaggttcctcaggtacagactgacccacacagtataacaggccagatggtacgactttagaactttaagtcatatttactatgtgagaatttttttactcatttatttccttcttcatctttccagggacagcctgtgaattgtgcagtgaattctttcagtatcactaacctgaatctttttataatatcctcttttacctaaattttaaaagaaatcaataaaacttttagttattatttggcattcagaattagattcaaatacgtctatgtgggtgcctgtgcgtgtgtgagtgtgtgtacctgctggtaaagacactgaagacatcattccagcaaaaattgatcactgtgtttttggatttggtcccaagttattttctgtgagatcctctttctcatttttgcttttgattttgacagaaatgacagctgaaatgtatctcaataattgagtttttaactttttttaaaaagatagcttactcaaagcaactgttgttcatagctgttgtaatttaaaggaatctatgtgatctttgcaaaaataactttcctaggatgaggtcaagaatgagtaatgtacaaccacagaaaagacgtgacatgccttcttgtctgaaacacgtgaagacacaaggaagccttcatgctaggtaattatttccagaggagcttccatgggacttcataaaagcattgacttaatgatgaaatattgactctattttctcagtgaacactctattcatttgagcatcccatcattcaaaccttgtaaatcctttcacagtcttcgggaatagggtccagattgtcatccgcatcttgtcttcagcagcaaaaaaatacacactcctcccccactcagagaaactgccctttagccaacattttgtgtcatttaattatttgcaagattcattaattggcaacagcccttccagattttccttagaattaacaatattccactataatttatagattatgtgtcactcttcttcctcagcttgaaaagggcatacatatttcaaaatcacttttgaatcttgaaatttaaacattttccccaatgacatctattttaatgcacatgatttaaaacatgagcttttgatataaaataaagatagtttgaaagaaaaatagcagcctctaagttttcatatggttcttcctcctggggatatttctagaattgaaaacacttaagagggtgcagaattctttgtcgagtgcttgcttttgcttatttagaaatagagggacaatggcagagaggggtatgaactctcctttatcagacctgccttctgggctcatttctatatcttatcaataatatgactttggacatacaattccaaatctctaggtcgtagttttcccatctgtaaaatgggaaaaccctcaacctcaacaaattttttggggggttaaaagtgaactaatatatgaaaaacaattttgtatgccctgaattatttatggaattttgtaacttgaggtttgctgacctaagttgtgaggttaaaggtttagatattggaattatactaacttctaggctgaaagtgagctctgccattcatgctcaagactgtttgctttctgacattttaggtttttattctttccaagtatttatcacaattagggagaaggcattcaaaccttagtataaatggttaatctgaatacagactaggaagacttgggtcattcaaattcacaaacctgtgtaagactgcattgctcaccccttcgggatggtttttcttggtactcattggactgcaaagggtagcacggtactgtgccaccccaagacgaccttagtaagaagcctgggtaggatgcagctgttcaggggctagtgtctgctgggactatgaggttctaatttaacctcacctaatgtctcacttctattattatccaattttacagccagtccatgtgaggcacagccttgccaaagttacatgactaaatagagaagctgcgatttagaaccacattttctcactccaaatcttgctatctcaatcattatattgtaccttatttgctgaatgaatgattgaatgaatgaatgaaggatgaatgggtaataaatagagagacattttactacataaaagctttcctaagttatgggaaaatatttctgagatagttatttctgtatatttgctaagggattagtaattttcaaagttaggatgccacatgtcataactggagtctattacagttaatcttatggggtctgagttaatgcgctataatgaacatggttgtaaacagaaaggacacccatttttgcattaaatgccattagctggtctgagagcaccttgagattatgacatactcctcattttgccatttttttccctgtcagcatggagcacaggttctggtagagcgagagtgctttacaaagacttgctgaggatgagtggattaaatctttcactcatccaaccgcttaagtccctgctgcactgagttaggagctgggtctagagtggtgagagaatgatccacaatttctgttctgatgaatatttggaacaaatgaaggagtgctccaaaggaaattgggatggtgtgtggttgaggacaatgagggtactaaacaaagtgaaaaagacctcagaaaagtggtcgaacgaggcctctcttggcaagtcacatattatattagatatgtgaaggtgatgtttgaaggaagagagtgaattagaaggatgtgtgcataccaggggcaagcgcatctaagggagagcagcccttgcaaagaccctgtgctgagagtggcatgctttgcctgagaacctcaagaatggccatggtggctggaacaaagtgagtgaagggtagagtaggaagagatcacgtgttaatggcatgacagagattgttcatgaaagtaccttttctatctttggaatgatctcagtagtttgttttttttttttttgaaatggagtctcgctctgtagcccaggctggagtgtgcagtggcatgatcttggctcactgcaacctccccctcctgggttcaagtgattctcatgcctcaacctcctgatgcacacctgagtagcagggactacaggtgtgcatcaccccacctggctaatttttgtatttttagtagaaacggaattttgccatgtcggccagactggtctcaaacttctgacctcaggtgatccacccgcctcagcctcccaaagtgctgggattacaggcgtgagccacagcgcctagcctggagtgatctcattctttttgcttagaaagattattaaaatatttcgcaaatgattggaccctgagtagattggcaagttaacttacagaactaggtttgagaaagtttttctctcagatttgaattgatttgcttgaatcatttttttttctaattttgtccaaccattagctctggaatatggtacattaaaaacaatttgcattgctccattgctgctaatatcaaggtcaatattgtcaaaaggcatggagatagaaggtcaagatgatgcctcaaacagcatcagtaatttaggacagcctgtcacaagagttaaagtgattgataagcaggaagaagtatgaacaattcattataaaggggactggatgacttagatgttaagcctactttaattttctgcatagcaattatattgctgattcacatatgaaagtattaggagacttgggataattgcagctgaggacacatcttttccattgttcgtgggacataactaaattctctgataaattaatcatagaacttatgggaaataatttaaacagcaacaacaatgataatacctcatatctctacagcacattgttgccttcagagcactttcaggtaggccattagacaaaccagtgagggagaaaaagactggcctgggaaagttaaatgaccctggttccactgaaagttcatggaaatgcagatcttgtgttaatcatgtcttctccttcagtcacttctcaattctacctcaaaagctcagactcttaaaggtttcacaccttgccttgcattatgtgcttgaagcccagcaataacactggaacttgggtaatgcagatatcgattgcccaatttacagacaaagaaactgagttgcagggaggtaatgtgacttcagtcagagaaagtgatagaatactacattctgactcctgaggattttttttcttattaatattttgagtacataaaaattgtctaatcccatgagcttgggagcttgttgacttagaaactaggtcttttgtacattgagacaggtaccgttttcctctatccaaagacaaaattgaattattttctgttacgactattctctaggatgtaatttatttttagggacctttcatttccagacttccagaagattcaaattggaatcttcttatcatcattactattctttttattattttcatatccagggtgtctataaatcctcttattttttttcttgttctactttccccagtaaataaccttttgtaagaaccacccacccccgcccccaccattccagtgtctttttattttattttttttccagtgtcttttattttgatcctgcttcaattttagaagatcacaataagaaataacatggggagagcagacctaatagagattaggatccatcattagacataaatgagacacagaagagaacaattaaaattggaatcctacaggtatgaactgttaccatataatgtttttttaaaggtgttagcctttctcatccttaaattgccttcaacaggaattctctttttggaatatgtaaaccatgggtgggatacagaagtaacctactctaaatggaagggcaaagtggtgataagattgggtttttgaatcagataatcttgagttcaaacctcaactctatcacttatgaatttgtgattgtgtaaaagttaaggaacctctgtgtggtagttaactcttctgtcaaatgggaaaatgactttgtccctcataaagaaggtgtgaagagaataaagacacacaaaataatgccttactgtgcttagtttagcttacagatggatttatgtcaaccctagatgtgcgtgggtggacagctgatcactgttattttgcttttatgactactgtatactgaacgctcactctgccaggcaatctgaatggagctagacattcagtggagaatgaaagacattagatccctctcctcatgaagtttacatgttaaaatagaaaaatataggccgggtgtggtggctcatgcctataatcccagcactttgggaggccaaggcaggtggatcatgaggtcaggagttcaagaccagcctggccaacatggtgaaaccctgtctctactaaaaatacaaaaattagtcaggcatgatggtgcgtgcctctagtgccagctactcaggaggctgaggcaggagaattgcttgaggtgagctaagatcacaccactgcactccagcctgtgtgacagagcaagactacatcgagagagagagagagagagagagagagagagagagagacagaaagaaagaaagaaagaaagaaagaaagaaagaaagaaagaaagaaagaaagaaagaaaagaaaaagaaaagtaacaatttggaaatgtacttcgaaggaaactaataagatgttattacagaaaacagaaaggacaggtacttaaagtggtcagagaaggccttttgagaggatgccccaaaaagagtatacatcgtgtaatcaaatactgtggtcaagactgttcagcacagtgcatatcctgtgcaaaggctctgagatgtgatcaaaaccacttaaaactgatgtatcatcaaggagttcatgattcaattcaactctccttaagtaaaagatgaatgtacctttttcagacatgatattttaactagctcatgaaatagatcaatttagcacaagaagtatcttttcacatgaagttaaatggttaaatttataaagttattacatattacaaatctatactccaattcttgatgaacgtttcaagaacatgttgacttttctcaaggaaaatgacaaaactatacatttcatatatatattatatatatatatatattcttatttatttatttatttattcttctgtgattttcctcagtggcatttgctaatcatctagtccaggaaagctcttgggaaaactatttatgtaaggtagataccatgataataataacgcaagagagaggaagtcacatagactaagagtggttctgtatttccaaggaggaatacattatttattgctgagaatttatgaaaaattttgcagaataggaaatctataagtcctaattctataaacatgatgaggaaacttttccacatgtggaatttcattttaataagtgactatatataatgccatatatcagcattatgcttagactggcacagagggtgtctgaagggaaatgatagatggggaaacctaggtggccccatgtaataggggatctgtattttaagaagtttaggcctttttattttatggcagggagaattcagtccaaaaactatggaaggtttacggttagaatgaaaattttctgagcaagttatcaagactatctaccaattacttcaataattaggcctaaagtaaagcatttctgaattagataagtcatttttatttgtacagaagaacacttcattaatatatttcaaaccaatggcaggtttacaagttatttaatagtggcatataagcataaagcagttggaagaaaccaatagtgatttggataatgcttgtgtatatattttcaaacttatttataaataataaattagcactccattaagaacacatgagatcatgatttggggagtggaaagggagggaacccatgcccggataaacaaagagtctaatgaatctaatgagtctgagctgggtagaaaatattaatagtagtcaacattctttcatgaaggacgtgggataaaaatgtgtccattatttgtgctggatgctgagtggtctggatggctcattgtcagaaaaaacaactttcttcactgcttttttgttctagtaactcttgctgtataatacgttagcccaaaacttagtggtgtgaaacaactgttttattttgctcatgatttttggcttatgaattataaaagaacccaggtggacagttctctcttgggatccctcacactgttgcagtcaaacattttctgggctgtggttgattggcctgctcatataagatggtttactcaggtggctggcagttgatgctggctgtcagctggaaactcagctggtgttgtcagccaaagcatctacatgtggctttgtcagctttgtattcttaaaataatcagacttcttatgtggcaactggcttcccaccctgagcaagcgccccaagagaccagagggtagctgagcctgcatggtcttctgtgacccagccttagtagtcacccagggtcaattccttcataccgtattgttgaaagcagttagtctacccaggcccaaagagaagaaacatagagtccaactccttgtaaaaagagaattaaggtttttgtttggtaaagatgatgactgctacagatttcttaatgatttgtggtcattaagaaatctatggctgggcgtggtggctcacgcctgtaattccagcacttttggaggccgaggtggatcttatcttatgtattattatattctaaacataatataatggggaccatttcttaatgaaggcattgataatgaagacctcaaaaatacatggagggatgccacgacatagttgaactctgatacattatgtaaatgaaagaaaccattcagaaaaggccacatactgtatgagtccatatatacatatatatatatatgtatatatatataaataaaatgtccagaatacacagaaaccacagagacagaaaatagattagtggtggctaaggggtggagggaaggggaaaatggggaatgactgataataggtatgggatttgggggagaagagtgatgagaggttgatggttgtacaaccttctgaatattgtacaaccttctgaatattgtaaaaccagtgaattgtataatttaaaagggcaaatgtttgtgatatccaaatgtatcttttcttttcttgtatctcaagaaaagaagaagttcacagatgaatttctaaaatctcaaaatactgtgttatcaattccaaaattaatattcttgcatacgttagcactctggaattagtctcatgatagctgtgtgattgttttctctctcagtagtacacaaagtgatgttgtatcataaaattcactacattttaaagttgataaaatatggtatatttctgattttacttatcaccagatacaaaggtaactattgcaaatctgtatttcaaagaatttacactggacaaattgttggatagatttgcctcaggctcctgagcagctgggattataggcaccaccaccatccctgactaatttttgtatttttagtacggacaggatttcagcatgtaagccaggctggtctcgaactcctgacctcaggtgatctacctgcttcagcttcccaaagtgctgggattacaggggattacaaagtgctgggccgctcctggcccagtgttttttacttgatatttataaggaggaaaggaaggaagaaagaggagaaaaagaaggaggaaagatgagggaaagataggacaggtggaaggaaagactgattttaccaaatgacgtttgtttgtttttgtctaccttaattcaaaacaagctcttgctgggaggaatggaggctgaggaagccatgaccaaaagtataattagtatcactgcaacgagctggggtaacctcaggcatgtctcagagcctctgtcgtcctcaaacatcaaatgaaggcatcaacaattgcaaacgttcaaatctactgatatttcctccactccttagttgttctttgtctagaaaactccagcctaatctttggactctgaacactcatcagaaaactatgatgtctctcttaagctctcagacatttgagtatttactctgagttctaagtgaataactgtttgagaatgagtccttcactaaattgtaagatgctccggggtcagaaaaaggctattatcttcacaactgtggcttctgacaattgtttggccaagtgctcagttagtatgaatggagggaattaaggtggggccttagcgcaccagaaattccatatcttaggttttaggtaacagaggcctaaattctggcagagcagtaatagaaagaaagttaaacatgtggctgagagaaatcaagagagatgggaaaaagaaagcgagataaactgagtccttattataggaaaaagttgattctattaatccaagcaaagtcaagaagaagaatgagtctggagtataattctctggagtggcataggagccattagcatgattttacgtttcatgtggataaccattttaaaaatgtcagtagttgtgtcttaatgtgttatagtaagaaaaaaaactaacacatcaaatttgtgatattacagttaatgtttcctaagagtgggcaaataatgacagggaattgttttaattcagttgaaagaattataatgataggtaaatgtaggtatacattgggaacgttgtggtttcagtttccagaggtttgagaccactgcaataaagaaaatggtgcaataaagcaagtgactagaaatgtttgttttcccagtgcatatacaagttatgtttacactatactgtagtctataaaatatgcaatagcatcatgtcaaaaaatgtacatatcctaattaaaaaacactttattgattaaaaaaaggtaacaatcatgtgagccttcagtgagttataatccttttgctggtggggagtcctacctcaatgttgatggctgctgactgatcagggtggtggttgctgaaggttagggtggctttgtcagtttcttaaaataagacaacaatgaagtttactgtatcatttgactcttcctttcacaaaatatttctctgtagcatgtgatgttgcttaatagcattttacctacagcagaactgctttcaaaattggagtcaatcctctcaactactgccactactttatcaaataagtttgtgcaatattctaaatcctgtgttgtcacttcaacaatgttcacagcatcttcaacaggtgtagatttcatctaacaaacaaacaaaaaaacactttcttagctcttccctaagaaacaatgcattatttgttcaactttttcatgagattgcagcaattcaatcatgtcttcctgctgtacttctaattctagttctcttgccattttcactacatctgcagttacttcctccactgaagtcttgaacccctcaaaatcatccatgagagttggaatcaacttctttccaacctttgttattgttgatattttgactatagatccttaatagtcttaatggcatctaaaatggtgaatactttccagaaggttttcaatttacattgcccagatccatcagaggaatcactatctatggcacctagggccttatgaaacgtatttcttagataataaaatttgaaagttgaaattactttttgatccatgggctgtggaatggatgttgtattagcaggcatgaaatcaacattaatcttggagctctggggtgaccaggtgcaattgtcaatgaacagtaatattttaaaaagaatctttctttgtgtgagcagtaggtctcaatagtgggcttaaaattagtaaaccatgctgtaaacagatatgctgccatccaggctttgccattctatttatagagcacaggaagagtagatttaacataattcttaatgaccttacagtttccggaatgataaatgaaccttggcttcaacttaaagtaaccagctgcattatgtaacaagagagtcagcggttcctttgaaattttaaagccagtcattgacttctctctagctatgagggttttagatggcatcccttccattaaaaagctgtttcatccatattgaaaacctgttgtttattgtagccaccttcatcaattatcttagctagatcttcttgattacttgctgttccttctacatcaacatttgctgtttcacatgtacttttattttatggagatggcttctttccttaaacctcgtgaagcaacctctgctggttcccaacttttcttctgcagcctcctcacctctctcggccttcatagaattgaagagagttaaggctttcttgtggataaagctttggtttagggtaatgttgtggctcgtttgatcttctattcagaccactaaaactttctccatattagcaataaggcttttttgctttcttattatctgtgtgttcattggagtagcacttttaattttcctcaggaacttttcctttgcattcacaacttggctcaatgtttagcacaaggagcctggatttccacctgtctcagcttttgacatgcctccctcactaagcttaatcatttccagcattaggttaaaagtgagagagaatgtgactcttccttttgcttgctcacacagaggcggttgtaagtttattaattggcctaattttaatattgtgtgtcaggaaataggtagactgagaagagggagagagaaagggaatggctggttggtgaagcagtcagaacacacataacatttattgattaatgtcactgtcttatatgggcatggtttgtgctgcaccaagacatttacggtagtaacctcttaaagatcaggattacagatcatcataacagatataaaaatcatgaaaaagtttgagatattaagagagttaatgaaagacacacaaagacaggaagtgagcacatgccgttggtaaaatggcactgatataaacttcctcgatgcagggttgtcacaaacctttaatttgtaaaaaactcagtatctgcaaattgcaatcaagtgaagcacaataaaataagctatacctttagggtccaatctgtggagaaaggaatgaataaatatggttatatcaatcagggttcccccaagagacaaaaccaacagaagatatatgtgtgtgagcacacagagagagagagatgattgattttgattttaaggaattgactcatataattgagtgttggcaagttcaaagcctgtaggcagaccagcaggctgaaaacaggaaggattcttgtattacagtcttgaggaagaactccttctttctgaaaaccctcagtttttgctcttaaggccttcaactgatcggatgaggctcactcatcacccattatcaaggataatctcttttatttaaatcaactgatcataaatattaatcaactctataaaataccttattagcaacatcaaaactactatttcaccaaacaactgagcaccatcatttagccaaattgacattaaaattaaccattccagagggaaacatttggtgaggtcagatttacaaataatgagttgcagatactgctggattatatgggtaaaaatgctcagtgaagtcttagaaatgaaagcaattcatgagcaatcaatctgccttcactttttcacctatttttattcagaaagtcacttagtctggaaaatgtcgttcatatggttgcatgccctattgttaagtgaatgagtgtttcaagggctttcctgttaggtttatttcatttagctctgttgcagcattacgatgtaagtgcttaccacaaaggtttgctaatgagtgcccttaatttgtattcagatgggagcaaagagaaggaaaaatacacaagaaggagtcttgtaattatgctacataaaattattaggcaatttagaaaattgtcagtgggaaactgcccatcatgcataaaaataattttgattttgatgtacagagtttaatgtaagagtgattgtagggagaccatgttattaatttttcccttaattatccaagcacacttgaatttattttaaggaaagtgatactttataaagttgagtcacgctactccagagaatacttgttttcgttctgtgacaaagtttattttgcagggcttgctgtgaactgtataattggtaggacgtgaaagaaccattaattatgtccttccccttcccctaatcataaataacaaaatgatgctatattttctggcaaactaaagtatatgtgatgtaaagatgttcaggtaatttgtgggcttatctattgtcttaaatatagaactacttttcactcatttttggcatacacagttgtgtattcagataattgtcagtgcaatgctaaatgtgttatgttaaaaaatgatgaacatattacctctcagttcttgttatagataatttcttgcaaattttaagctagagatagtcaatatttaatcagagaacatcttcccaggattcaaagtataccacatcagctgttgaatgcagttaatttgcattaatgtgttacaaatcaatgttctgtagtattttaggaactgtaaaacatacctttcaagacaaagtccaaactctttagtatgcaatatgtagttaacctattctggaatgtctcttctaactgagagccaccctgtagggaattaccttagtcttttaattcctgtttgtatcaggtgacttagcaaccacctgcatagcaggaagacggcaccaaggaatatattcatccccttacatagtttgaactatgtgaccaagaaattacagtccatttgtatagagtgccaagctctgaaggctggaagacatgtaagttcatgtataagcataagaaggttgtccatagaatgaaaagagaggaggagagagttaagggccatctgggctcccagagaaagtgagctcaggtcccctttgggccctaaggatgaaacaactgccctttgcctggattcacttgactgggttctttgctgtcattggtagacacatagagccctcctgtctgctttagtcttgttctaccttctcagcctcatatagcaatacctcttatattctgcccccacccaccctgaccatctcagtgatttttgaataaatcttgtctttcactcgcctctgcctttgcgtagaggatacctgctgtgcaaaggtgatgtgagaaagtcaggtctaaattcacctccagactctgcctttggtgggctgtgtaatattatgcacatcacttcaatccttagatttctcatgtctagtatggaggaaatagtacttaacatggagacttttcaggaaaattaagtgaggtattatccacacagccctcataatggtgcccaacactgtggttatcaatagattttagtaccatttttgccagaaagttgaggcagattctaatccaacttttaatatccagatctatccattattccctgattcagtccccaaggtcactcattctttcccttcagctccacaaaaaatccacttacaaatattttatacactaaatcacatcataatcattatggatttctccaaaattaaagtaacaactttttctggttctctgaaaatatgaataaaagaggctgataatgctgcatgcccagaggtgaacatggttcaataagagagagagaccttgtggaagtgatgctggaattgaaatccaaggattgagtagtggcaatggaagaagagaatagtattccaggcaaaatacatggatatagattccaggggaattatgtatgaagaaggagcatagtgaaacttaggccctgcaaggccagtgcagcagagataagcctgtttccttgggtaatggtagggactgtagggcacagtgaacagtgtttatgtcattctataaataatactgataggaccacttattgagtacttcttacatgccagaagttctttggtgctttcattacattaacttatgctattgtccacagtattctaaggtggttgctattagatttccaattttacagaaggggaaactgaggcacggggcggtgaagtaactcccagaatgttcacagtcagcgaaatggtggattctgaatacaaatgaacacaatgaggctccaggtttcctgcttattatcaccgcgaagcccagcctcagcgagcaagggaaggagctagagagcgggctcccaggcacatctgcatgtgtgcactggccttgtaacatcagtctggctcttaagagctgatcagaaagaggacagaaggggagctggcacactggttaggtgaaatgagaaagctcaatgagtgatgatggtaattcagactagaatagttagtgttattttgtgaaaggaaatttcaatttaaccagagcaccttgaagtgaaggctttgaattggaaagaaggttttaaattgctatcagaatttgccattttagtgattgaaacattttagggccaaatgtgccatgctgcacctttccagaaggaactatttgagggaaataactgtcagctcctatagtaccagtgtttaaaatgtaagtttagggagaaaggcagttcaccttctctccaggtggggactgactgaggtgttgaacaaccagatttggggatggtattttttgaatttaattaactgctacatgtgaactagtaagatcaaatcacccacaaggtagatatttgagaaactcagtgtaaatgtggaaaagttgatgttatgttccaaagatgtaataaaaaattaaccagtttatgcaaatgtttatgcaaattaaccagtttatgcaaatgtttatgcaaattaaccagtttatgcaaatgaaaagaggaggtaagaaggtataagatgctatgtttgcatcattcactgggaacatttgaactttgcagattaatgtccttggtggaagaagttatgacattatgttatttgttggggaaaaaccctccagtgtaaagacttttatttatttatttattaaaggcaggatctcactctgttgcctaggctggagtgcagcagtttgatcatagcttactgtagcctcaaattccagggctcaagcaatcctgcctcctcagcctcctgagtagctagtacaatacatgccaccatgccctgctaatatttttttcttttttttttggagacagagtctccctatgttgcctaagctggtctcaaactcctggtcttaggcaatcctcgcacctcaggctccctcagcactggattacagaatacttaaaaataacataaatcagtcagatatttaagcctcacaaacttttcctgaagatttactgagctacttcttcagatgaaaaagacattttgtaataaatggtttctgaaaaaccaaaccctcaaaattgtaactgggatggatatgattagtgaaacacattaaacttaaccctacagggataaaccaagagcgctactgatgtttataaggaaatacaagcattacatcttaaactagacaagtttccactgctgagctaccctgagcttagtgaaattaactattttcacaaaatggaaatccattaatggaaatgacatcataaattcagaaaagattcttagattttaatatacttttcctaatttaaggcaaattgagccaccaagaattgaaagagaacatatttggataattgaaaggcagagtttaaacattccggaaataactatctgcactttcaaatgcaaggtcttgcttaggtttggaacaacacaggttttcttgatcacttgtctaaaacagtaactgagagccacacaacacaacctcgttttataaaggttgtctctgatacttagaaaaatctaaatgtttctgtacttttgcaagttactaaagtctttccattaaattatttgacttttttttctcccgcccaaaaagtgattagcgcacaacaaaatgtgtgtgatttgttaatggagtattctttcattgcagatttatatgttcttaaaacagtgcaagccttttgtggaaataatgtattttgaaatcatatattcttatatacatgtctctaaaagttcatcaaataaaacgtaggaatagacatttttacaaacagaaaacagtcatgtggttctgctatccaaacacagtgacatgatcttttagagtttattttcagtcttttacatattgaccctgtttttcctccatatttgtattcttttaggtttgtttacagagttgtaatagagcatttgtgtgaagcagtttatatggtaagtgacagaaattcagctcagagacactaatatactcacaggatgtattggtctatattgttcctctaggaaggtgtgatccagaaactcaagagaagtcatcaaggactcagtctctctacatatttttcttcctttataagtaaatggcctgcaaatcttttctcatttctgccgctctccctgaaggacctggtagagtacttccttttgaaatatctggctgcagttggcctatagctcagtctgggtttctggcttgttctgtgcatttgtttttcgtgcttcaattagccattgtgtcctggtaatggaaggaaacaatcctcagagatcttgtcacactaagtctgtggcacaatttgaaacattcagtaataccagctgttctaagcagaacagaagtcataattagggatgcaatgatttcacactaaactgtagttacagaatatataactacattttaatgctcatcaatttttatcttatactgtatttatcttcaaagaacaaatgaaccaagtgaattggatttcagatacacagagctggatttatctaatattccctttctcatcttctgctgtaaaaaaattatttcttcttatgtaaactacctaagaagtatcttttcctcccagaatactgtagctttgtctgctcaaatccaaattatataaaatggcaaagctgctctggaacacattttggctgtttaatacacagttaaacatacaatttccatgtgacctcatcatcccacatccaggaaattatcctaaagaaataaaattgatgttcatgtataaacctgcttaataattttttagaaaagtaccattgccaagaactggaaacaacccaaatttccttcagtgggagaatggacaaaaactatggtatatgcataaaatggacaataaaaagggaaaaattattgatatgtgcaatctggataaatctgtagaggcatcagtataagtgactgtagctagattaaatactttgtaattccatttatgacattctgaaaatgtaaaagtatagggacagattggagattgccagggattggcagtgacagaagggtgtgttaattacaggggcagcatgaggcatttctttatggtgctgggatcatcagtatctgtttgtgctggtggttgcaagaatcttcatatgggctaaaactcatacaactgtatagcaataatgtgaatattactgactgttaaataagatatctatgagtgaaccttcactaggcaaataaaataaataagtattaacacctgtgactcatatctgttgtcattttccaaagcttgaagcccagcataacatcatgcttggttttccaattcatcatgcttttgatctttgtatgacacatgcagaatttgggaaacatcttgggagataatgagtttttagtaatttgggagataatgagtgctatgttgggataagttaacacttgttttgttaaatattacatggaagggaatagagaaaaagtctatgcggcaacaatgatgtactcttagcatgacacatggaagcttatgaaaaattattaaagactttgcactcagttaccaaaaaaaaagtctattatgtaagagatctggatcacccccagcagatgtagggctgaattgttggttgctgttcatctgtaaaaaatgaatttcccaaatgcttctctagtgcttattcagctctgcttagagaagttttatccttgcatttatttttttcttttcgtggccatagtgagaatggtattaagaactgggctaagccccagttctgcatctgcttgctcctttaaattagtgagagcaagctcattctagttcagttcctgagtagctgtaattaatggtttgtagtattcacatggcttttgaaaaggacccctttctctctttaaagcacctttaaactttctagaaaaaaaccatgtaatactgccttgaaaacagtcccttctgggtgtcatttcaactactttcggttcaacttcaagttgtccagggaaaataaacccatcaagtagtgcctgcattgttagcttgagaaccagaaggaacttcgaccacatttgcttttgagaatgtaataatttacatgtgatatatgatcgtttagttaagcaacagtgatacagaggagcttcaccttggcctcatccattgattgtgcagatttcaatacacttgtttaagctttgtggatgtggttgttcattcaatcaacagaagtttacttttgcctatcctggaccagaaatcagacataagctcaggatattaaaagatgcttatatgtgtgtttggggaaagggataagaaaatgtagagaaaacagagaaaagtacatgttgtgagatatgtttgataaaatctgggttgatcaaatttaaacaagattccagaatttgtaatgtattaatatgcacaatgacctttcaagaatggaatctaatgtgcaatgattctcaaatctctctgactgggaaagcccctgttaatttttctcagagaactttataattgtagtatccttttctacacactttgcaaaatgtatggatgttagcaaaaaaaaattatcttttatgtattgattattatcagcaatgcttcttactgcctcagagccagagaaattgcaagcagtgcctgaagtgttgtttgccaagcttctggtaacatacaacattgttttttgttttgttttgttttgaattactgtttatcaaatagaaatttagctatgtcagtggtcagaattgtggaaatagtatacatacaaacttgttttgttttgggaagaactagatgattaaggcagctttgctatgtggtaaattatattttatgcctgggtaacagttgtcaactaaaaatgggagatttgctgtcagaacttgttgagagtggcatgctcagtgtataagtaggtttcctgccataactacattgagtatatgcattatataaatgatatatgagtttttagtaatttgaagagaaatgtaatacctaaatacattttcctttctgttacttaccccatatagttttgcaacatttagtgccaagctaaggtgacttttgattattgaattaacttcttaattccaaagagtttgtgcacatcaatagaattttgttcaaataaattagactatagactaaaaacaatttctagaaaaacatgttggcttgccacttaagattatttctctgatgtctaaaacaaattgaaacttagtttcaatgtagcattgtatttaatataatcataatttcaactgttttaggaaaatattttattaataaaccaccatagtccatcaaacagataatctgtattatactagcatgttagcttaaaatgattttgtatatattatcgttataattatatatatctaatgattgaagaaagagaactgatccactacattgttgttgaaagtgaatttagaatgagttatatgttaatgcaatcttgctatctttggctgattctggaaggagttgaaaccttaattgatcaatcacttgattcagctgaaacttagagtgaagatttaaagtgttcttaatttgatcaaaatggcaatttttttttctgaatccaatatgtggagggaaacacaaggaaacagtaattaccattatgaaagtttcatgaaattatggtgacacttttaagtctattttttaaagagctttattgagaaacaattcacatactatgtaatcccccttttaaagtgggtcatttaaaggtgttgatattcacatagcagtgcaatcaccgccactatttaattttagcatattttcatcactcagaaagaaacctcataccattagctgttagtctacattcgcccattttccataacctgacaaccactaatctacgtatgtatttgtctagtatggacatttcatacaaattgaatcctacaacatgtgatcatttgtccctggcttctttaaattaacaaaattctttcaaagtttatccgtgttgtagcatgaagtacttcagccttttatgagtgaataatattccattgtatgggtatatcagattttctttattcattcatcagctgatggacatttggcttgtatctacattttagctatggtgactaatgcttctatagacatttgcccaaaagtttttgtatggacatattttttcacttcttttgagcatgtaccctagggatggaattgctggatcacatggtaattctgcatttaacatcttcagtaactgccaaactgttttctgttttgcaaagtggctctagcattttaaatcccaccagcaaaaatgtgaggggaccaatttctctatatcttcatccacagttattattgtctgccttttttgatattaatcatcctattggatgtgaagtggcacctcattgaggttttgatgtgcatttcttgatgaatgataatgagcactttttgtatgcttattggccatttatgcatttttggagtaatatttttcaaattattttcctatttaaaaattgggtgatttgtgtttttatcattattatatgacattttcatatgttcaggatacaaatcccttttgaggcatatgacatccaaatatttatccattttgtgaattatcttttcattttataaaattgtatcctttaaagtgcaaaagagttaattttgacaaagttaaatttacacatttcttttttattgttgctgaccttttgttgttatttctagtaaactatcacctaactcgaggacacaaagatttactcctatgcttcttttaaaatttttatagttttagctcttacatttaggtctatgatctattttgagttaactcttcatatggtatgaggtcaggttccaaatttattcttttggatgtgggtatctagttgtctcagcagtttatttaaaaaaaaattctttcctccactgaattgtcttagcacccatatagaaaatcaattgaccataaatgcaaagatttatttctagactctcaaatctattccattgatctatatgtatattgaaatacaaattccataggtcttgattgctgtgttgattactgcaagtttgtaacaagtattgaaattatgaagtgtgggtcctctgctttgttctttctcaagattgtttggttattctggaatcttgaaattctctacgaacttaggattaacttttcaattttggcaaaaaggccagctggggttacagtagggatcacattgaatctgctcatcaacttggggactatagatattataacaatattaagtcttctgattcattacattgggtctcatttcaaatatttaggctttcttaattttttcaacaatgtttgttgcataatggaagacttgtattgtttttcttaagtttgtttttaagtattttatttgtaatgctattttaaatggaggttttttttttagagtttccatttctctgcttgcattacccatctgcttttgtatgttgtccttttcttttccccattagaactcttagcaaattaatcatagttattttaaatttctgttctgctaattccaaaatgtgtattatatctaagtcttgttttaacgcatgctttgtctcttcaggctgtgttttttatttgtttatttgttttcttttggtgtgacttgtaattattttgttgaaagccacacacggtgtattggataataagaactgagaacattagtctttgattgagattttatgttcatttgccaagcaaatgtgtttactgtttgttgtagttatgatttcagacactaaatttttatctaatgttgtgtttgagtcttgcctgttgtctttgggttctcctagagactccttcttaaatagttcattagccttgtagttttttgttctagcctgttattatagaagagtcctattgatgtggtgataagctgccgtgagaggggaagcattttacaaacctgtgattagatctgaaccttttagtgaacatgtgtccctgagatgtgaccatcacaaataattcttggctttccaccttcctctaaggtaaaacgggttttgctagagtctaaccaacctcagacaaaggaaatacccaactccagcccactctagcctttcggctcaggtagtattatttccattgagggcagacctttcttaagaacagagcactctgggtatatttcaaaatacaacaccagaggtttttctcccatcttcactctgagacccctggtgggactcctgaaggtaaaagttatgaaagtgtgtgagggctcccgctaaagctgggacaagaggaattttaatttctcattatagtccacgctcagtctccagtagtgagtaagttcatttttaatgatttatgactgttgttgtctccaatagtggcttccgttgttccttgtaagctctatgtattcaaatgtgtctctagttttgtataatggttgtttgccctgtgacctaaattctctgatatatctaagaaaagttatctattttcaggtttttttttttttagcttctttcttgttgtgaggacaggaaatggatgacagctttcaagctttttaccttttggactgaaagttgaaagtcctcaatggaattattattattattattattattattattattattattattattattattttgagacagggtctcactttattaccccagctggagagcagtggatgtgatcttggcccactgcagcctttgcctcctgggcttaagtgattctccagcctcagcctcctgaatagctgggactacagacatgcaccaccacgcccagctaatttttgtaatttttaattttcttttcttttggtaaagatggagtttcaccatgttttccagactggtctcgaactcctgggttcaagcaattcatccacctcagcctcccacagtgctgggattacaggcataagccactgtgcccagcctggaattcttttcttaatttcattttcagattgttcattgctagtgtatagaaatatgactgatttttgtatataggcctcatatcgtgcaatcatactgaacttttaaattcgttccagtagggtatgtgtgggtgtgcatttgtgtgttttggtatttttgcaagataatatcatcttcaaatagagatggttttactttttcattttcaatcttgtcttttatttctttcttaactgattgtcctagctagaacctatactgcaatgttgaatataagaagcaagaacaggtatgttgtctgttttttattttagggggaaagcgctctatcttgcatcattcattataatggtgttggtttttcataaacgctccttatgagtgtgtgaaagttcttttttattcctagttttctgacagtctttcttatgaaagaatgtgagactttttgccaaatgctttttctactatcatggagattataagttatttatatttgtcctttagtctattgatatgatgtattacatcgattaatttttggatattaagacaaccataaatttatacaataagtaaaaaatgtttatgttgtacaatcctagttatatgttgctagatttggtttcttactattttgttgagttgtattttgtatgtctatgttcagaaggaatattggttcgtagctttgtgttcatgtttgttttgcttttccttgtgaggtctttcttgcttggttatgtatcagaataacactggtctcactttgagtcaataagtgattcttcctcttcctttattttttggaagatttacaaaggactggtattaattcatctttaaacatttggtagattttatcagtgatgtcatctgggcttggtcttttattgtaggaggttttaaaattactaaactgattttatttatttgctatatatattcagatattttatttcttcttaagtcagattttatagtttgtacccttttaagaatttgtccatttcattaagattatttaatttgctaacaacagttgttcatagcattccttattcttcttattttcctctaagtttggaagtgatatctcctctttcatttctggctagcaatttgaacttctgtattcatggttagtctagttaaaaatttttcaatttggtcgatctttttaatgagctaaagttttgttttgttgagtttctctatatttttagttctctactattttttccaatctaatctttattattttcttttcttctgcttatttagtttgctcttatttctccactttcttaaggtatatgtttaggttttgatttgagatatttcttcttttttaatataggcatttgtgcctattaatactttactaagcacagcaatagctgaatttcataattgttggtacgttgttttttctgttaattgatctgaaatgatttcctaattccccttgtgaatttttttcctttgactcctttgttatttaacagtgtgggttttgtttgttgtttgtttgttttttacttacatatatttgtgaatttcctaaatgtcctttagttaatgatttctaaaatttcatttcattgtgttcagaaaatatactttgtatgatttcaatatttttaaatgcataaatgtttgatttatgtcctaatatgcaatctatcctggataatgttctgtgtgaactggaaaataatgtttgatgtttttaggtggagtgttttatagatgtctgtttaagtctggatagtttctagttttgttcaagtcctctatttctgtattgatcttcctcttagttgttttattcattattgaaagaaggtgatcaaaatatccaactattagggctgaattgtctatttctcccttcaattctatcattttcccacatatatttcagtctatgttgttaggtgtatatatgtttatattaataattaacgtatattactgatacattaaaaatttatcattataaatttcatccttttcctgagtaataatatttgtcttaaagtctctttcgcctgatagtatgttttgagttatttgcttagtttttgtccaggggattgcaatttacatgttaatttataacaatctaattggattagtagcaaattaatgtcaaagcttaaactcctctttgttctattattgacatacaaattcattttttacattataagtcaatcaacacagttttatccttattgcttgatacagttgtttttaaatcagataggaaaagaaaatccttacaaaacaagtatatttatattatctgttatatttacctatgtactttaactagtgcttttatttcttcttgtggatttgacttcctgtccagtattccccctttttatttaggttgtaattttttcttaacatttgaatgataaaatgaataaatatagactttttagttggtagtctttttcttttggtgctttgaatatgtcatcccattgccttctggactccatggtttctaatgaatagttagctgttcatcttattgaagactccttgtgtactgtaaattttgtgtttttttctctttgcattcagtctttgacctttgacagtttgactatgatgtatttgtgtgtgaatttctttgaatttatccaaatcagagttttttgaacttccaaaaatgtagattagaatttttcatccaatttttaaattttcagttgaaattctttaaatattttttccgctatattctctgttttctttttcttggcctctcatccatcatgcacatattagtaagcttcatagtgtcccgtacgtctctgagtttctgttcatttttctttatttgtttttctttctattctcagactggataataatcaatggatctatctttaagttcaccggttcattattctgacagttgaaatctgctgccaacaccttcttgtgaatttttatttcaataattgtactgtttttgaccaaacttcaatttagtactttttttgttgttgttaccatgtcattctgctgaatctatttagtacttttttatagttgctaatcctttattaataatctcagtttggagaaatcagtcccagactttgctttatttctttggatgtggtttcttttacttctttaaacatatttataataggtcattcaatgtctttttctagtaagtccatcatctagtccttctcagaaacaattttagttgactatttttccacatatgtttaggccatactttcttgtctcattgagtaccagtttttttgttttttgtttttttttgagatggagtctcgctctgtcacccaggctggagtgcagtggcgccatctcggctcactgtaagctctgcctcctgggttcacgccattctcctgcctcagcctcccacatagctgggactacaggcacccaccaccatgcctggctaattttttctatttttagtagagatggggtttcaccatgttagccaggatggtctcgatctcctgacctcatgatccacctgccttggccacccaaagttctgggattacaagtgtgagccaccacgcccgaccattgactaccaatttttaactgcacattttaaataaaataatatgccaacattgtaaatcaaatacccctccccttttgcttttgttatttctacttcttggttttgtttttgttgttgtttgcttttagtttctttcatggactaattttgtatagtttgtgtttttggtcatgagtaactactaaagtatttactgggatggtttggtgtcagctaatggttggaatattgatttccttcaatcacttcaatcaatatgtttccgaccatctgccaatgggctctctacttgtgctggggatgacttcaatctttggctgtttacaactctgttttaaccttaacttttatttatggaaaggctcaacaacagtcagtgtgagatgttatgacattttcaagtcttttctaggtatgcacacagacttttaatgcaactttctagatccccaggaatatgttagaccttttcaaagttccttattttcctgatatttaagggttttggtggcttgcctcttatttgcttcaactggtatcaccacatcagaaagctatgaaaaacaattgcctccaattgttttcaataaatgccctatgaatagggcttctcaatgcttgaattctgagtcagggcaagtaaatactagcctcataaaaggagcttttccatgaggaaaagccaaagagatcaactagtaacagttctataatgatgaaaatgcttgatctccaaactccttcttccctgtcctatgtatgctgggttgctgattttcacagctgttactgttttgagtttgctaatttttaagtctatggaactaaggtgagaggaatgagaatgcagttagtgaaaatgccataaagctcactgttcttgccaagatgtattcacttattttgaataaattgttctagcatttgtataagcctttacaaatgtcaagagtaataacaaagtagattttgacaattatttgtcagtgttctaatttcttttagggaggagtaggttttcaaatgtccctattccactattcggaaagtgctttcaagtctacaactgccttgataccagaaatcaagttagatttataaaaggggttaatttttggcctactcacaaatatctttgctaaattttctggaagcaatcatcaaaacattaaaaaaagataatgtcttttcttctctgtgataatcctattagcatactatgtttatcttcttgctcaaaatctgcatacatgtggagaatattcttaaaaaaatggacaatacatattattctgcaacttgagtgattttacatagaaagaaatgggcattcctccatggatataaatttacttacatatattgatctgcttatcaaacttattctttaatcactctcataattgcacaggatggatctgttatgtctccttcagaccagatattcaggtttatagcatattttttaaacacaaaaaacaaaacagcaaatagatttacatactgctgccttcattcctatagagggaggtccattagagaaaacttaatgaatcaaatgtttgtgccaatttatttaataaaaagcttctgaatttttactgttatgcatatgtgcagatattacactgaaaaaattgtatctgttcctaaaataagttatcaaatcgtgtatttgtacccattaatcaacttctcctcattctttcctcctctcaaacagtctaccttctgttttcatgagatccatttttttcagctctcacatgtgagtgagaacatgtgatatttgtctttctgtgcttggcttatttttcttaccacagtgaccttcagttccatccatgttgctgcaaatgacaaaatttcagtatttttaatggcagcatagtattccattgcatatatacaccacattttttttctgtatttcttctaaaaaaaaaaaaaaaaaaacaggatacatgtgcagatcgtgcaggtttgttacataggtatacctgtgccatggtggtttgctgcacctactggcccgtcctctaagttccctcctgtcatcccacaccctccaataggccttgttgtgtgttgttcccttctctgtgtccatgtgttctcaaggttcaactctcacttatgaatgagaatatgctgtgtttggttttctgttcctgtgttagttgctgaggatgatgatggcttctagtgtcatccgagtccctgcaaagacataatctcattcctttttatggcagtatagtgttgcatggtgtatatgtacaacatttccttatccagtctatcattgatgggcttttggttggttccatgtctttgctattgtaaatagtgcaacaataaacatatgtcttcatgtgtctgtatagtagaatgatttatattcctttggatatatacccagtaatgggattgctgggtcaaatggtatttctggttctagatcgttgaggaatcaccatactgtattccacgatggttgaaataatttacatttccacaaacagtgtaaaagcgttcctatttcctcacagccttaccagcatctatggtttcctgacattttaataatcgccatttttgactggtgtgagatggtatctcattgtggttttgatttgcatttccctgatgatcagtgatattgagctttttttcatatgttcgatggccacgtagatgtcttcttttgagaagtgtctgttcatatcctttccccatgttttgatggggttgtttgtttttttcttgtaaatatgtttaagttccttgtaaattctggatattagacctttctcagatgggtagattgcaaaagtgttctcccattctgtagattgcctgttcactctgatgataatttcttttgctgtgcagaagctttttagttaattagatcccatttgtcaattttggctcttgttgcaattgcttttggcatttttgtcatgtcaatgtcctgaatggcattgccaggttttcttctagggtttttaaggttttaggttttacatttaagtatttaatccatcttcaattaatttttgtgtaaggtgtgaggaagaggtccagtttcagttttctgcatatggctagcaagttttcccagcaccatttactgaataggagatcctttccccattgctggtttttgtcaaatttgttgaagatcagatggttgtagatgtgtgatgttatttctgaggtctctgttctacttcataggtctatatgtctgttttggtaccagtaccttgctgttttggttgctgtagtcttgtagtatagtttgaagtcagatagcatgatgcctccaggtttgttctttttgcttaggattgtcttggctatacagggtcttctttgattccatatgaaatttaacctagttttttctaattctgtgaagaatgtcaatggtagtttgatgggaataacattgaatctataaattgctttggggagtttggccattttcacggtattgattcttcctatccatgaggatggaatgttttttccatttgtttgtgtcctctcatttccttgagcagtgctttgtagtcctccttgaggaggtccttcacatcccatgttagctgtattgctatatattttattctctttttagagattgtgaatgggaattcattcatgatttggctttctgcttgcctattgttggggtagaggaatgcttgtgatttttgcacattgattttgtatcctgagactttgctgaagttgcttatcagttcaagaagtttttgagctgagatgatggggtttcctaaatacaaaatcatgttgtccgcaaacagggacaacttgacttcctctgttcctattcgaatactctttatttctttctcttgcctgatttccctggccagaacttccaatactatgttgaataggagtggtgagactgggcatccttgtcttgcaccagtttttgaagggtacttccagcttttgctcattcaatatgatattggctgtgggcttgtcataaatagcttttattattttgagatatgttccatcaatacctggtttattgagagtttttaatatgcagggatgttgaattttatcagaggctttttctgcatctattgaaataatcatggtttttgtcattggttctgtttatgtgatggattgtgtttattgatttgtgtatgttgaaccagctttgtgtcccagaggtgaagctgacttgatcgtggtggataagttgtttgatgttctgctggtttccgtttcccatattttattgagaatttttgcactgatgttcatcagggatattggcctgaagttttctttttttgttatgtgtcttcccggttttggtatcaggatgatgctggcttcataaaatgagttagggaggagtctctccttttcaattgtttttaaaagtttcagaagtaatggtaccagctcctctttgtatttatggtagaattcacctgtgaatctgtctggtcctaggctttttttcgttggtaggctattcattactgcctctgtttcagagcttgttattggtttattcaggaatttgacttcttcctggtttaatcttggtagggtgtatgcatccaggaatttatccatttcttctagattttctagtttatttgcatagaggtgtttacagcattctctgatggtagcctgtatttctgtggggtcagtggtggtatcccctttatcattttttattgtgtctgtctgatgcttctctcttcttcttctttattagtctagctggcagtccatccattttgttaagttttttcagaaaacctgctcctggactcattgattttttggagggctttttgtgtctttatctccttcagttcttctctgatcttagttattccttgtcttctgctggcttttggattagtttgctcttgcctctctagatttttgaattctgatgttaagttgtcgatatgagatcttcctagctttctaatatgggcatttactgctatatatttccctcttaacactgctttaactgtgtcccagagattctggtatgttgtctctttgttctcattggtttcaaagaacttcttgatttctgccttaatttcattatttacccaggagtcattcaggagcaggatattcaatttccatgaaattgtgtggttttgagtgagtttcttttcttttcttttttttttttttttttttgagatggagtctcactctgtcacccagactggagtgcagtggcacaattggttttgagtgagtttcttaatcctgagttctaatttgattgcactgtggtctgagagacttatgatttccattcttttgcatttgctgaggagtgttttacttccaattatgtggtcgattttagaataagtgccatgtggcactgagaagaatatatattctgttgatttggggtagagagttctgtagacatctactaggtccacttgatccagagctgagttcaagtcatgaatatccttgttaattttctgtctcattgatccatctaatactgacattggggtgttaaagtctcccactagtattgtgtgggagtctaggtctctttgtaggtgtctaagaacttgttttatgaatctgggtgctcctgtattgggtacatacatatttagaacagttagctcttctcattgaattattccctataccatgacataatgcccttctctgtcttttttatctttgttggctgaaagtgttttgtcagaggctaggattgcaactcctgcttttttttgctttccatttgcttggtaaattttcctctatccctttattttgagcctgtgtgtgcctttgcatgtaaggtgggtcttctgaaaacagtacaccaatgggtcttgactccttatccaatttgctggtctgtgtcttttaagttttggcatttagcccatttatatttaaggttagtactgttatgtgtgaatttgatcctgtcatcatgctgctatttggttattttgcacactagtagatgcagtttctccataatgtcattggtttttacattttggtgtgtttttgcagtggctggtaccagtttttcctttctgtatttagtgcttctttcaggaacccctgcagggcagtcctggtggtaacaaaatccctcaggatttgcttgtctggaaaggattttatttctccttcgcttatgaagcttagttttgctggatatgaaattctgggttgaaaattattttctttaagagtgctaaatattggcccccaatctcttctggcttatagagtttctgctgagaggttcactgttagtctgatgggcttccctttgtagatgatctggcctttccctctggctgcccttaacagtttttccttcattttaaccttggagaatctgacgattatgtgtcttggggttgatcttctcatagagtatcttagtggtgttctctgtatttcctgaattttcatgttggcctgtctttctaggttggggaagttctcttgaataatatcccaaagtgtgttttccagtttgtttccattctcccttctccttctggtactccaatcaatcataggtttggtcttttcacatagtcccatatttcttggaggcttttttcattcctttccattcttttttctctattcttgtctgcatgtcttatttcagtaaggtggtcttcaaactcttatatcctttcttctgcttggtcgatttggctgttgatacttatgtatgcttcatgaagttcttgtgctgtgtttttcggcttcatcaggtcatttatgttcctctctaaacaggttattctagttagcaattcctctaaccttttatgaagtttcttagcttctttgcattgtgttagaacatgctgctttagctcatcatagttttttactacccatcttctaaagcctacttctgtcaattcatccatctgattctctgttcacttctgtgcccttgatggagagatgttgcgatcatttggaggagagacactttggccttttgggtttttggcatttatacattgattctttctcatcttcgtgaatttgtctacttttggtctttgaggttgctgatccttggatggggtttttgtgggggctttttgttgttgttgttgatgatgctattgttgttgctttcttctggtttgttgttctttcagtagtcaggtccctcttctatagggctgctgcagtttgctgggggctcacttcaggctctattcagctgatttgctcccgtgcctggagacgtcactgaaggagcctggtgaacagcaaagatgggtaccttttccttcctctgggacctctgacctcgaggggcaccaacctgatgccagtaggatcactcctgaatagggtgtccgacaaaccctgttggagggtctcacccagttgggtaggatggggaacaggacccattttacaaaacactttgtcctttggtggagagagtgtgcttcactggggggaaacccactcttctgggctgcccagattcctcagaactaccaggaggtgaggctaagtctgctgctttgcagagactgtggccattcctccctttaggggctcaggcccagggagatccaaaacctgtccctgagcctctggctggagttattggaggtcctgcaaggaagcccagcccactgaggaaggatgggtcagggttaggcctgaagaggccctctggccacagactgccacagccagtgtgttgggctgtggggacaagtcttgggaccaaaccttccagcctttctggctccagcaggtgaaaagtgcagcctggagctgtagaaatgggtgctgcccttcccccacccagggagcttagtgtgttaggcagttgcaagtcccagtgctggctgccccttccccaaggagcttaaaccacttagacaacaggcagctgcagttggtgctggtcacccctcaccccaggaagtcattaggattaagcagattccagctgagaggctgtaacaatctgcgctttctggggttgggatgctaggcccttggtggcatgggttcatgagtgggatcttcccttccatgggttgcacagttccgtgaaaaaagcagattgcccggctgagtagcacgctcactcaccacctcccttggctggggggagggggttcttctttcccatgtggctttcaggtgggccaccacaccacactgctcttccttctcttcatgagtaggaaatagactagccttctagacaattttgatgacagaacttggatacctttgttgctggtgatggattcacatgcttattatgtttttttttttttcatatgagtctctgaatgccagtccttctagtcggccaccttggtcctgaccctaaattattactttctgtacattaacttctactatacctttgtgtttatttatgaaatgcttacttgtttcttagggcttatttgtccaattctaggtcaatatactattatttgtaatgttttaaagtcaagaaagagtgtttctcatctttttctccagcatttttttagttcttagatatctgttctaccatatcacaccaaagtcatttgctgggtttttgtaaaatcaagattttgtttgaaattgtattaaatgcatatattagttgtgaaaataattcatttataaatatatgatatctcctgcatgagcacaggatattctctgtttgtttgtggttcttttatgtaattttcaataaattttatactttaaaacaaattatgaccttcaactattttattaaatgtgtctttctttcttcttttgagagggggacaatgatgataagcaaaaattgcccccatatgtataacttacatgttttattaaattaccttaggattttttaactctttagtaatttctagggtttttcaaagtgtatcatcataatatctgtagagtttacttttatgtttcttatggaaaattgatatttattacttaatttacatatcctattacattagttaaatcattaaagcaattctgagtaattgtgaatgggaagtcctgatttctattttactttttaaaattaattaattaattagttatatatttaatgttgtgttcttggaataaaattaatttggtcatggtgttttattcttgtaatacactactggattcactttgctagtatttcactttcaattttatatccatgtataaaagtagtatgtatatcatgtttttatggtattatgtttattagctttagctattgataggttttattgttgttactttagctaataatatgttttgttgttgctttgttttgttttaggtttcataaaataagttttagaacattgtacgttattcagctgtttaatattattgatgtaaaataggtataatctcttatattaaggtaagtagagcatatctggaaagccatgtgggcattaggacattttctaatggcagattatgtttcccatcttttctatgatcactggactctacaggttctctatattttggtatttaatttgagaacatgattttctgttgaaaatcatcctttctctagatttgtattattttcattaccaaatttgcccatattttttgaaatttttgtaaatatctcctctgtgtacatacttacatctcatttattatatataatgtacatttttacttctctcatttaaaaaaaaaatcctttctactagtttgcctgtttgattttttttttttttgaacagccttcttttagttttatttatatgtatgctatacttttgggctttttgcttcattaatgatagttttttacttctttaattctccatcctgttattttggttgattttgatgtttcctgtgtctcggaggctttgcagtgaaacttgattgttaatgtaattgagattcagaagctatgagatgtggctaatatcttatctgtaacattgcttaaacatgactttgtggaactcttgtggagatggtaactttttcctgaatgcttgaatcagctttgaactatgcaatcaatttacctgtaatccaggaggctgcaagaagataggtcccatggtaaatgattgcaattcttttatctggattcataaaaatcatctgctaaacacttaagacattatattatattagcttacattaagtactctgctttttcatattgcctcacactaattattatgctttggttgcaaatgtattttaaatcttaagagcaatccaaatggcagttttattgtttactgtggtccttgctgactatagtaaattgtttgctgactcagcttaaatttagaaaatgtgcacatattttggatttcttcccagaaatgaatgtggctataggtaatataaatacataacaaatccccttggatttagaaatttgtggaatttcctttggcattgcagattagcagttaatccttctttcttagctaggtttaaatattggagcaatttgtagactcttagaagtaatagttttatctggacactgattattttgctggaaagcaagaaatcaggtccacacgaagaataccaaggagagaaacatatgttaactttaaaaaacaaacaaaaaatgtcaatttgtatattggtattcaagtgggagcgataaaccattaatacacatataagggatttcggagaaaatgttttggtagcagatttctgtccttggcatctgtgatggagggaggatgatttgcgagtcaactgtactgcggtagaaacaacattgggtttcatgttagtacatgtagtttcaaatccggggtctgctattcactgtttccatgaatttgatagtcactttcattcggaaacttcattttcacatgcataaaaagttgtataaatatcagtactttgtacaagaggccaattcaatgactgtcctggttttgcagggaaaatgaaccggcccgcacagcgatgagagagtgctgtagtaacatgggcattggaagaggatccccgcaaatctttaagaagagggacaaaattggttcctagatggggaaaaccaagggtggtgtattaataacagatgaaaataaggaaaagaattaaattactttgaaaattctgagggaaagggaatcttcaccacatcatcagaatcacacacagcctgctgtggtgaccaatcaccagtcagatcaccaggaggctctcttactaaacgttgaggatatttgcaagttttagtccataatgcctggcatccgagtagagactcttgtcccttacaattttactttctttccagagcttgataatttagttctgatacctattattgtgggattgctgttgtactgtaggcaaatgactcacttcctcaagttcgaatttcttcatttttacagagatggtgatgatgccttgttgttagagtgagaatggtaggatataatgtgtgtttacattcactgacctggtcccttgcctagcattaattaatgattgatgcatgtgaattacctttccttctgactacttgatatgtttcattaggcattcattcaattaatagtcattgattctgactctatgctagagacactactcagtgttacacgtgaaacaagattcctagtcccagcataatggagcttgcgaatgaaagagggagatagatattaaatcagtcatgccagtaaacataattataaattgtaaggtggaatttgaaggactcatagaaagttctttggcctggttaaagacgcattcacagagaaatggcaattaactgggatctccaatgtcagtaagagttaataaggcaaaggatgggtttagtgagaaggagatccacgtggaagcataacatgggcaaagtactagcttcaagaaggcttatggaacatttgagcaaataaggaaacagcagggtggctggagttcagagaggaattgggagatggtgcagcacagtctccatgcccttctgcttctgctttacttttaaggctcagtgttacctatggaaagaaaaatagtcagagtctacacatttatcaaattcatcagccagaaatcttatcagaaacaaaaagtaaagccttcaggtgaggactattgagcaccaaagatcttatttctgtgtggatttttttttttttttttttttttttttttttagtgaaataagatacatcgaggaggcaggtgcatagaagtcacttggaagtgacttctaacaggcctgttatgccagctggtttttggtgttgtaggctgaacgtgaagttgatataattgggctcagtatgtgtctttccttagagggagacagccgctagaataataaatcagcagtggaactttcaatagatacttctggaatgtctttgacttttacatacctctcttggcatttagatttgaatctgattttcagagaagaaagggttatagatcacaatctgagtcttcaacagcatatttgtagaccttagaggagtaagaaagaaggggagagggagagaaaaaagccctgggacaacttctgtgatgttaggatccaggggatgcacttggtttttttctccattgtgatatcccacttgacacatcacgattacaaatgatgagtagcctaggacaaaaccaccagcttcggtaatttgagttatcactcatgtaataaatatttattggacacctgtattgttctagatggtaaaaaaaataaaaaataattatgtttctttcaagcacttcatagtccttttgggcgctagacatgtggacaattacaataatgcagattaacttttttaagaacacacagtttcatgcagtttgttaaattattttgaccaaatatctcatcaatccttttacaaccatttttttcatatgggacaaccaagacttcaagaactctagtaatttggcaagtacccatagtttctaagtgacacagctaggattaaatccagtttcctcttctgtacagatcatcctcctaatcactgttatatattattccaacaaaatgtgtcaatcaaagtatatgcaaaatgccaagggagcatctaggagggattatgtgattctgactgaaataactgaggaaagttttaaagaagaggcaatatctgtgctctagctcaatgctcttgatctgggccagttgtcttcaaaccctggaaactcactatgatgtgataaacacagagttcctccatagtgctttcattatgaagaaatgtaagaggtgaactggtcacctatggggataatagggaacacagccgttatcataaatactgggaaataaaaggaaagcaataatttgcacttttctatatcaaagtatcccagctaataaatgaaagaagaaatgataagactatcaacatttggcagtccttctccagcaataaattaacatgttcattctcttaaaaaaaatttgttgtttgtttgtttttgtttttgagatggagccttgctctatcgcccaggctggagtgcagtggcacaatatcagctcactgtaacctccgccttttgggttcaagttattctcctttctcagcctcctgagtagcagggattacaggttcgtgccaccacgtccagctaatttttgtatttttagtagagacggggtttcaccatgttgaccaggctggtcttgaactcctgaccttaggtgatccacccaccttggcctcccaaagtgctgggatgacaggcacaagcaaccacccccagcccaaaaaattattctaatgtgactaaagaaaagaagaagttgggataattcatgagctgcattctatacacagaatgagacaaacaattgataaataaataatatataatttaacttgtgactagtgctgcaatgaagatgcactgatagaaaatactaaggtggaggggggaaaatgaggggagggccttcttgattagagctagacaggaccaatgaaaaggcattagacatgtagagctactagaagtttccaaagcagagggaaagacaggtgtgaaagctccaaggcaaattcaggacataggaacagaaaagttttcattgaaactatattatgagaagcccataaaaaacaattggaagattgcctctattttcaggtatcttggctcattttcccttccaaatgtttacaataaagagtgctacaggtcaaatccttgactgatgttattatcagattctttgtaaaattacttaatacagaaccaacaaagatggatttgcataagcagtgatctgaatgcacgtaacatgtgaaagaataaatgctataacaggctgatcaaatatttaaggaaaataaggtttaatttagtttcaaaagccatgctacagagacagttgagatgctaattaatatcctctgtctaactccagcacacaaagcatttggaaggtctaaggttcttcttttcttaagcaatttcttcatagaggctgtccccatgccagtttttttttttttgtaccctataacttctcccagaatgacatagttaaatcccattatttgagctgccttggcagatgactcccaaactgtatgtatcccttctagatacacaccagggtggtcagcccaagtacccacaaggacataaacatttgaaggacacagtagaaaattagagtattgtggatgtcattcctcacctaaaggccttggcaattatctatttaacggatctgttttttcctgtgctggacaaataggacatagctttaagttttccttaacagcaggatgttagcatgtcacttctatcctaggttcatctagagaaggatgtaataagcatgccttcttaggggctctctgtgtctaaaatgaaattttctgattaaatgcctttctcccactgtttcccttagcttgctggttggtgtagttatccaagtactttctcccgctaaaaacttgggaaataatttggattttcctctcctctccacctgtcataccactcaaacagcaagacttactgattctataccctaaacatgtgcctgggagccaggtccttttctcctctctgttgtattccagtaaaatcactcccaaacttgtataactctgtttcactgatttgggtctttctatttcattctccagaaggccaccagcctgaatttattaaaagtctcatttcattacactgggtaaaggcttctactgagtgcagaaccagtttattcttagctttacattcaggctactttactatctggcctcaacatacctaactctaatgtgcttctttggccatcaacactcagatacttaaatggggattaatatcctttctcaaattatctgcattcctaagaccacaccctcacttgtgataccaagtgatcactatcagaggctgccattttccccaactacctcctacttatttgttcatgacccagcttaatgtcagaatatccaaggaaactcccttcacatttcaggctgataaggtcacttccctgtgctgtgaatgttctttatctgctttggcatctttctcacaggatcatgcactttgttccaaaatggaagaaactgtggactttaaactcacgcagtattggcacaaagtaggtgtttaataattatgtaaaggaatataaatcattctattataaagatacatgcacagatatgttcattgcagcactgttcacaatagcaaagacatgggatcaacccaaatgctcatcaatgatagactggataaagaaaatgtggtacatatacaccatggaatactacacagccataaaaaggaatgagatcatgtcctttacaaggagagggatagagctggaagccattatcctcagcaaactaatgcaaaaacagaaaaacaaacaccacatgttctcacttataagtgggagctgaacgatgcgaacacatggacacattggggagaacaacacagactggatcctgtcacggggagggagtacggagaggtaaagaaccaggaaaaatagccaatggatgcttggcttaattcctgggtgatgggctgatctgtgcagtaaaccaccatggtacacatttatctatgttacaaacctgcacatcctgcgcaagtactctggaacttaaacgttgaagaaaaaaaattcaaaactgcttcccgcaatgtcccctgcccccatgcctgaaaaccttgtaagattttggttctgaattggaaatcgtatttctttaagaaggcagatttcttattcctcaggaatctatatacctgctcccagaaacagtagatggtatgtcattagacagaacctcccctgagggcatccctagaatgccagaaaaatggatcaagaggagacagtaattaggagttttctaataggagaagaagaaagacaggaatctgaaacaaaacttgtttaccagggctgttgttgccactgcaaactgtgcaagaaaacaacaatgtctcaaatgctactctctaggaatggagacagtgggcagaaatggatgcttctcccaaattatggtaaatgcagagtgccaaaacgagcttctttctttctgagaatgttcttctatttgaatttaagcttataggccacggagtgcaggcaaccagcagtcggggaggccaggcacagtggcccatgcctgtagttccagcactttgggagctgaggcaggaggatctcttgagtccaggagtttcagaccagcctggacaacatagtgaggccccatccctaaaaaaattaataaataagaaaaaaaattatcattgaaagaatgagttaatgaattaatcagtgcatatatgttctccaaaatttcactcacactttaaatgttgcttttctaagtcagtatgcttcctgattttacatgtatttattcttcctacctactccttccacccccagatgcacacacacttacctatggctttcagccatttcatattagggaatttgcctcattgttgtattctatgtaacaactagcagagttgcattcctctcttaagtagtttttggtttgaaaattgcaaaagtattactgaactttggaggtgttcagaaactgtatgtcggaagagcttgaggctcctctgcatgtggtattctagtggatggggaatttttcaatgaatatacaaaatctccaaggccttctgctgtgtaaaatataaatagctgctcttgatgttcacactcattcctacacaccttcaactggtgcaagacttatcctttagagacctcctttcactagatacagttccgttacgccttttaaatgttgagtgatgacaaaataggacttattggaggggtaaatgagggatggtgacgagaacattgattttagtcccaaatagaggaagcattcaaaaattatctagtttccccaagaaatgtgcatccctaagaaatacagtgctgcggataatttccagtcagtgtctggaggatatcttcagccattagaatcataatctactattagaaacaggtattcaattttactagggaaatgtataatgtgctccacttgtgatttttctggagaggaatgtcaaatttgtattttgcctatggcagcccccacccgctttacagcatctagaaaaattgggatttaacaaggaagaaaacactagggaaaagaaatcatgtttgcactgcttaagatatggatttaaaaatatgtattttaaacaattttacttatgaagttctctgcatacatttacagagtattttctatgaaccaggaaccgagcatgtggtggatagttaggcatggtctctgcttttcaagggctcatatcttattaatatacttttgtggatgtaacagatttaatttttaatgaacataaacatagggatatcaaatttgtgttcaaaacatctaaatctcaattctctcccacaaatggctgcttctttccccagctcccctgtattagaatgctctcacctccatatcaccaaggagatttctttctggatcttgttattgataatgattttataaaaagtttttgttcaacttttattgcacttaattactgatttggtgaattcgtatacatatatattcatgtttatatattcatgcatacataattgtctataattcagcaattatgtgtatatatatatttatttatttgtataacattgactatcccatttgtaccctcaaagtaactgaaaactctattataaactccagtgcctgctctgaaagttaactgtcaagtcttagctctgcaatttctcaagagtaacataactccttctctcattcattgcatattatcttttacactgaatgaataggggaaatagcaagaaaaggagaagcactggaatgaatgcagcagccatcaggccctttattctgttcctcaagcaaagactctttctgcgagcctagggcaggtccgaaagagatggagctatctgaaccacgtggggccatttggaacaaggcttccagatgatgcagtgagctaaggtgaggcagcagtcagcttccctggtagtagaggaagttttctcagaagagatgcaagttaaacaggggtccaacaaaggaagaatgtctagtggacattttgcaaaacataaagtcagctgacagatatctggaagagcctgtgagatcttcagaagaaaggccaggttttttgttatccttgcactcatgcactggcatgaggcccagcctgaatgaaagatagaactcatttttcaagatgaaatcatctttgcatttgccttagcttgcggctggtctggcttctgagattgctgtaggtactgaggaagaaaaggaaagaattcataatcacaatcaataacagagaacgaataacttgaagtctatgatgagtcaatctgtgtatgcattcatgcattcttgcatttgtctctactaagatgaacttaaatgcccccaagagacacattcccagggactcacatcttcagcacatcaggacctcctcacatggggccacatcaagcatatgtgtggtcgcaggctgtcattccctactcaacgtctttcagggtagaaacagctccacttactccaatcatatacgtttttttgagcaacctgtctgtatcaagggcagtgtaaagagtgaagatcaaaacaataactcattcagggctgtaagaactcacagtctgatgggagagagatagcagaagactatgggtgacatgatacactcttctcctccataacaagacactagccatgggtttggaaagaagctctataaaagtggtttctgtggattttgtttgtttgtttttaagcagtatttctgcaagaggatgcatgacagagtggagtggtctgtagaaaaataagtttgagatatgcttttacttttatacatcaagttcaacatttccctctctggtaaatttttataaaatggattagcacactacaagttctcataaatcctgcagtgaagaaacctacttgttttgtttaagttaggatttaattacccccatgggcctctctttggggaatgctgctttatatcttccagacggcttccctgagttattgtgggtgcctataggcctggtgagcacagataagacctgcaatagaacccataccatcagagcacttgaggatggataaacctttggtctcattctggctaatcttctagcaagtcaagcagttaaaaaccctgaagactggccttagcagctggtcactcagcttctccttggtgggaaaactcatgctttatataataaaccaaaatctacaacttttgactgctctttttgatgttgtgttctgaagaaatctgcctacaccctcttctggagcagatttgaaagcatccctcaaatctcttgttgccaaagcttctcagaaatttgactcttcaaacccaaagccactctctagtcaaactcttctcatcctctgctcaggtggatttttaaaaaaggcactttaaatacgtttattgattgcataattagtgtggatttaacttggtcaacacaaaatcatttatcaagttcaacactgacatttttattttggtaaatcttattgaatccaacaaaaatttccatgtaatggacagcctaataaaatactcaacagttgccctgccacaactgaaggctttgttttccatagtcattctctattagtgagtgtttctctctgtttatatgttttccctagtgtttaactcaacatcatttaatcactaaattggtatcacaggtatttttctaaattaaaagccttatcatctacgttaactgcttggctactgaagagttgcttcttcctgatacaaaaaagaatagcaatataatagtaagcagttctgtccctctgtaatacctatgtgtgccagatggtggtctaggtgctgtaaacaattcaacttatacacacctcaagacaactctagaggaagatgaaattatttttcccattttataattagaaactgaaatgcagggaacttaaataactcatctagatgactcaaattagcatatctagttggagcttgaatttgaacccaagcagtcttccttcagagtccacactcgtaaggattatattatatgacttgtctcagttgaattagtacagatttgatcctagaaggcctccagtacaattgatttggctgtcaaatatttaaagaattgaagaatcacctgtgaccatgatgaatagggagaattcatgtaggtaaatattaacattagaaaatttatctgataaatgcaagaaatttagcaaaacccaggagtgatggtgtggggagcttgggtgtttgtttcccatttcacaaaacaaagcagccaaccttacattcatctcaacaagtagtttatttaacttctcagaggaagagcagcaaatgtaaataaaatcaataacagcgactgaaaaatcttaacagggaatgtatatcagctttcctctgtgtgcctctgcttgtctattttattcaagatactgaatacatgatttctcatttgggtttctgtgctgtactaggcttcagcaatatatgcatcaaacattttgaaagtctgccccaagaggcaaaaagaccatgtgaattatacattgcctcacagagtgatgatactgtagacctacttgcatgtttgtttttgaagaatttcatccaggataaaaaaagagaaatatagttgaaagggttctataggtttgacaattcaaaataaaaaaatgttatctctatggaaagtcatagtggttaagtaggattcatatctcttctatttggaatccagcatggcctcttctattgttttgtctgccagactgtgagtgtccccagatctatgatattttgcaaaagctgagttgttatcttagctgatgtctaataaccctatttatggcacagccatgttggaaataatcattagtattcttagccttgttctataaactcataatgatgtgtttcattgtttgtggtgttagccttgggctgttagacacaattctgtttacgactatgaagtcagactgtccatccagaacatgacggattatgtattcactacatctgctgaatcagctgtgtctgtgcagtgaataccacatcctcattttcagaactccatgagctttcaggtaaaaatctataagatttaccttgtaatgtatagaacacaatttatttcattttcttccgttaaatttattccttgtggtttctgttatccatagcttgtagtttgcattacaagttgaaattcctttttgtttttgctgtggtataatatccatgtgagaatcgtctttcttcatctcagatagagaaatacaaaccacccttttactcattcactgagagactgaactagcacatttttataaaactggatcaaaatgtgcttgtgatcagctgtcatcttgtggagtttccttttttttttcttgccacaattggagttctaaaccccttataataagcacatatattagatatagtcatgtgttgattcaataacctgatttcttccctcctttggctttatcacatttgtcatataactgtcaagtctccctgagtatttgcccaacatccattgagcacatggcaaggagaaaatgtggaggattttatggagatggtttgaaaggggattcccatgccttctgtccacgtttctgtggccaacagtcagtcacatgatcccacttagatgcaaggggttctatataatgtagtccctggctcaggggatgccccagagacagttctatactctaaaagaggagtatgaatccttagtagacagttttccaactgtaccactctgtgtgatcttagaagactttctgagcctgttttcttatattttaaatgaagagaacttaactaccttacagattattattattattatatgggattatatacacaaaaaacatgtgagctgaaaaatgctacacagattcattatttttataaatgatatgagtaaaatttatttatttatcttaccttaacctagagaattagaagagcgctcaggagctaggccgtattatgagtaaattgtctttgtcttcataattgtactttttcttcagagcttcttttgtgtctttatgggatgtgccaacagagcttatgaagtcaaatcttacagataagaaggaagagtctgggaaaaccaggatgattgattaccctatctacaaaccgattttgaccatttccagggtttgttgtctgtaaccattgcattaattcaatagtaaaaattatcaaccaaagacaatacctaaactaagcatcacacaaaattgtctccacaatagctttatgtagagagaaaccaatgtgcaaggtatcaatggcacctggtgtctatactatgagaatagatatagggaagatcatgcacaggttaaaagcctgatgttttgagctaaaaaaaaaaaaaaacctagtttgaacttatctgtacattaaccagttgcatagatctcggtgagttatttaacggtcttgtcttctgtttctcatttattcaacagagagaaggttaaaagcatgttgtttttattagagttgaatttgatgatgcttctaaagggttagctgcaggggaggtccactgtggggatttagccacatgcttttcatgtgtcatttttacatgtcacagaaatgctatggatatataaagttccacagtgagatagtcataaaattggaactggaactcaggactgtctgaatccaaagctctctttcataatcatattttgttccctttctgggcatggcattgtgcctggcctatggcaattgctcagtaaatcacagcagttattgttctctttcatatctgtgcccagatcaattgccagatggaagtgggtattttgttctttagtcatctatatattagacttgagcattcctcacagtgctagtggagccacaactgccccacaccctctgagatatggctctcccagaaccttcatagacaaggcataaagttgtttgctatgtactttatctgtattaacaattttacctatttgtaatgggtttgtttttctaagaagtttgaactatgagtactcccctttctaaaactggttatgaggaagaatagaacaggatataaaagaatatcttagaaacaaagaatggagaatatatgctacactcgtgttcaaacagttaaaaaaaataaaaaaatgccaaaataacttacaaaatagatcaaggagacaaaacaaaaagcccgaagtgtaaaatataatgtattattaagctagtatttacaatgaatgaggagaagatcaattacttcatatatactgcacaaccattcagataaaaaaagttagttcttcttttcatctcaaaacactcaggaaagcacccaatttcagatggaccaaacatttaaatgtttaaagtaaaactacaaaagaagcagaaaacacaggtgatatctctttgatttcagggagggaaaaagctattcaaagcaaacaaaaagttaacaatgaaatcaactatagaggcaaattgtatatttgggaagttaactgctaaaggaaatctgtacatcaaaaagcatattaaactaaattgagaggcaaatattaacctgaggaaaacatttgcaacgtactctcattgagttttcacaatattcctgtgaggtagataataatatctccatttataatgaggaaattgacagcacagacactttaagtaatttagtaatttgcccaaggtcattcagctaatgagtggagggactggaatttgaaccctcaaaaactgaactccaagcactctttacctcacacgtggctccctcgagtaagaaaacagctctagagcccagggccatgattttgtttgtttgtcccataataagcagccatttactttcagataatatatagtcatacattatttaatgatggaatatgttcttagtaacgcatcattaaatgattgtgttgtgcaaacgtcatagtgtgtacttaagcaaacatacatggtatagcctacttgcaaacctaggctatattgtatggcctgctgttcttaggacacaatcttgttactgtactgaatactataggcaattgtgacacaatggtaagtattactgtatctgaacatgtgtaaacataggaaaggaacagtaaacatataggacaaaaggtgaaaatggtaccattgtacagggcacttacatagagcttgaaggcctggaagttgctgtaggtgagtcagtgagtgagtgatgagtgaatgtgaaggcctgtttactgtacactactatggacttcataaacactgggcacttagattacactaaacttttttttttttttttttgagacggagtctcactctgtcgcccaggctggagtgcagtggcgcgatctcggctcactgcaagctccgcctcccgggttcacgccattctcctgcctcagcctcccgagtagctgggattacaggtgcccaccaccatgcccggctaattttgtttttgtatttttagtagagatggggtttcacctcgttagccaggatggtctctatctcctgacctcttgatccgcccacttctgcctcccaaagtgctgggagtacaggcgtgagccacggcacctggctagattacactaaacttattttttaaattttatctattcaataataaattaaccttagcttactgtcacattttacatttaaacttttaaattgtttcactttttgcctcttgtaatagcacttagtttaaaacacaaacacattatacagctgcccaaaaatatctgtttttatatctttattcttaagctttttactatttaaaatatttttctgtcacttttttttttttttttttttggtagagagagggcttcactttgctgcccaggatagagtgcagtggtgtgatcatggctcactcccacctcaaactccttggcttaagtgatcctcctctggctcctgagtagataggactaaaagtatgtgctacaacaactggctaatttttttttattttttaacttattattattgttattatttggtagagaaagggtctccctgtgttgcccaggctggtatcgaactcctaagctcaagcaatcctcccttcttggcatcccaaattgctgggattacaggtgtcttttactttttaaaactttttgttagaaagtaagacaaaaacacacacactagtctaggcctactcagggtcagaatcatcaatgcatcactaggtaatagaaatttttcagctccattgtaatcttatgggaccaccatcatatatgccagttcctttttcactgaaatgttattatatggtgcatgactgtaattttgggatttctactctgattttttctaactagagtaaaagaaagttcaatatttaatacatagaaacaaaattgtgacattaaaaaaacaaataaaacaactccctagaaatatagagctgccattagaaacgctgcagcaagcctcattgtctcctgagtaccgggcctgacactcggcctgccccaggtctggccatgtctaagtgctgaggaaggaagcctttctctagagttttggtccacgccagcatccttttgcagttctcctctgtagcctgcattttcaggatgcttccatactacggaatgtattatttcctctccttggaatgcctgcgatcatcataggtatctaggaaaccatttttcaaagtgctagacagtattaggatatctttgaagtcaccctagagctacgtaatcattcctaataataaaataaaaacttccatgcatctgtgatgccactcacactagataataattttatgttcatttgccttattcctctattaagctggtctattattaagcctccaatttgtctgttagaccaatgatgcccaacctttttggcaccagggaccagttttgtggaagacaatttttttccacagacaggtggtaggggaatagggggaatacggtttcaggatgaaactgttccacctcaaatcatcaggtattagattctcataaggaacacatagcctagatccctcacatgtgcagttcacaatagggttcgcgctcctttgagaatctgatgctgttgctgatctgacaggaggtggagctcaggtggtaatgctcgcttacccacctctcacctcctgctctgtggcctggttcctaacaggccatggaccagcagcagtccatggcctggagattggggacccctgtgttagacaatctctgtgtctcctgaatccagcatagctaggaacataggaggagctgcatgatacctggtgagctgaaccaaactccacggtgaaacaacagtgctctgtgtttattctccaatgtgttcatttgagttccatatcataattcagcacacactgggagcacagaagatcccctgaccagcatcagcctgtagggacctgaatgtcagtgaaggttaccgctgccttgtggaaaaggcactgatcactggaatggaaagttcaggacaaatttggcagtgataaactcaacccctctgttctccctgggctgatttttccgctaagaaaatcttaaggagggtctagcacccactgtggggttaccatttttaaagagcttgatgcacgtcaaaaagagcatgtaatttgggtttgaaagaaaggaagacaagaaaggcacagaccgtggtgtgtgtgtttgggtgggtggggtgtgctggaagacagggcagtctgccactgggcctcaggccctgagagcctgggagagtccactgtgtttctccaggatcttccctgactcagttccagacaggctcttcacaaagactcctcagttcatcacatgattcccaacccaaccaggggacagctgtccatgcttgtgctgatggtctagctggacaaagaaaatgggtgaaccagggtatataagttccttggaggactgagagatgtagaaactcttctaagaagagtgtttccctctttggctttgtaatcttattgcattatctttattatcaatgacaaacagagcatccactctgttccagacattttcagaggtgccagggtacaaagatgaactccatcctgaggaactggtcacatctgtctatagggaattcagtctatttgtgtgccagaagagcataaagacactgacaaaaagaaaagtcattaaggggccggcttctggaagagagatgtcactggagaatgaagtagaaaaaggctggagaaactggaaccaaaggcaacagggaccaagacctcgctctgtctctcaagaaggacacaaagaacagtgattatagtgtacaccttggagtaagatagacctgggtttaagtccctactgtgatatttctaaattccaaagcctacacccaacctcatgcagcatcagttttctaatctgaaaaagggaagaaagaatatgtatcatcgttgggttaaaagagttgaatactcacataaagcatgctcacatagtgtactcacaggctcacctgaggtagcattccccatgcctcagtgacttgtgggtagaaatgaaggcttactaatattcatgctcagaattttcagctgcattgcctccactggaggaaacagaaggtcatcagcctcctgcattgagtctctccattcactggcagtttctcttagattgatacagtctgcttgccacactgtagccagagcagtttgctccatcaccatggcagggctgctaccaaataggccttcttgtccatactcctgtaccatacctttaggtcactggggccactgtagaatcaaagcactttgtttagttcttggcatgctctattacctgcatactaccgtgagccacatcttccatcaccctgtttggttctcaccattctgccatgtctgtgagcctttaccttgcattgctgtgcattgctgtaggctgagggccctgcacctacttcaggtttctctacagagttgcactggtttctaattgttgctgttactaccaccattgttagtgttatcagcagacttttttgactgatcggattggattgtaagcaagtgcaagtatatgtattcattcattcaaaaaccacccactgagcaactattgcatgttaaatattatttcagacaaggaggatgcaatagtgagcacagctgacccaatccctgacctcattcagaagtttatagtctagaaacatatcttctctcccatctttctgccggagaaaagaaaaacagtgctgctctgtcctgtgttgaattatttctcaacatctctgcatcatcctttaaatgtagtctgtgctcctcccgtctgagccctccaacagcatccacttgatcccagagaaaggaagtaatattcacctaaaaataacaagcatatcaacctcagcttctgccagccatgattccctgggaataccatttctttcaggagctggaacacagaaaatatcagcagaagttaccccaaattgttgagcccccttggttccagtcagaatatttttcaagaaaaaagataattctacttcatttgctcattgctctggttgtcaggagtatgatacggaatacaaaagacaaagaatcagtttggaaactgctagaggaattgagtaatggcaaggtcatgattctctttattttgatagctggtggggaatttgcttcttgcctctccctaactggagtgaggattgcatctttctccgctttttgctgcctacacaatctcactttctttacaagcccgttccattacattctctttctccatccctttgccatttttcttatgtgtaaaacaggaataatagccatactgacatcaagatatgttttgaggactgagttggtacattgggttatggaaacatgtccacagtagagcgcttaagggttgtgcggctaaggctttggagtttggcttcctggcttcgttatttgctttgacttcccttaggcaaattttaacctctctttgtaaaataaagaaactgatagctacttaaaagttgtagttatgacttacaaatcatgtctacaaagcatgtagcacagtgtcccacatagtaagtagtgaatataactagctactaaatttatgatgaatattattatatctttcttttcctccctttacctcaagagtgctacttaatttgctctgttttgatctctgtctttcatgcaactctctattcatttcggtgcaggaaaaaactgagatgagaatgacataaaatctggagacagtgcaggctttctggcttctcttcttagctacacgtgcagcagggttatggcagtgcagggaatcagcagatagggtctctggctgagcaagaagttccaagggagcacagatatgacactgcagggggcctgttctcaggggtctgcagtccctgtgtgaccctgctagagccttgcaccagcagctgcagtgtgaggagcacctccccaagaagagccctctatcctcccacatgcctgctctttgagcaatagtcatctgttcaggacgtatgcattatttccttctccatttgtcatatggattgcctaatatttatctgtgctgtttttcacattactctgaaaggtttctaagttatacttctttatgtgctcttggattgctggcttacaccaccactgccaccaccatcaacaataccacgactgctaccaccgtcaacaatatcagcactaccgccaccatcaacaatactactgctgccaccaccatcaaaatcatcaccattaccaccatgaacaccctcacaaataccattatgatcagtatcaccaccactatcatcaacaccatcaccaccacaatcaccaccattaacaccattaccaccatcaacaccaccaccaccaccaccactgccaccaccaccatcgacaccatcacaaataccattgtgacaactatcatcattgctatcatcaacaccatcaccaccaccaccaccatcaccaccaccaccattaacaccatcaccaccagcacccaccattaccaccacttccactgtgtgtcaagcttcctctcctctgggacattttttctgtttctggctcagacttgcacatccctcctatttgctttttctgtttccacattcttatcattgcacatgtcacacccactaactgattttggattgaatcctataaaatacagctcatgtagatttatccatttgaaattgcttaaatttgaccgtttttgactgtttgcttatttcacatattcaagctggtatttatctacgcaccccattaaactgttagttacgtgagaaaacaaggagaacttttactctattttggcaacacctggcacagtgcttgatacttgatacaggtgcattgaataactgaatgaggcatatggcataagctttatagactctgaagcagtattcaaatgtaagagactgctgcagtaaaacaattgagcatataaaaatattttcatattaggccgggtgcagtggctcacacctgtaatcccagcattttgggaggctgaggtgggtggatcacctgaggtctggagttcgagaccagcctggccaacatggagaaaccccgtctctactaaaaatacaaaaattagccagacatggtggcacatgcctgtaatcccagctactcgggaggctgaggcaggacaatcgtttgaacccgggaggcggaggtggcggtgagctgagatcacaccattgcattccagcctggacaacaagagtgaaactccatctcaaaataaataaataaataaataaatctatctatctatctatcttcatattaaaaatgtgacctgtccttagaggttgatttggaaatgaagaaaagaaaagtgtgagactttgaatcatagaagttcaaatatattccagagttctcagggtaagtcaggggcagccttgggggatgagtaggtagggtcccattttcttcttctgtctctgctgctctacctttatttgtttgtatattaatgatccaaatatacatatacacatatatatatatatttatattactcataagaaatttaaaaattctgcaatagatgtcatggagccaataaaggacttcaggcagggaaatgtcctgttgagattagtaattttgggatgtaatttttgtttggggcaggagcatcagtgatggggtgaagagattgaagctggaggcccaagggtcagtgaggagatgggagctgagaagaggagatgggctggacaggaagctaggaatattcatctcactggaggatgcggggactgagaggggaagtctgccttgatcccaagattgggggtgattagggggctatgtggatagcagtgccattctcagagacaggtgctgtaagaatagttttggggagaaagatagtaaatctgatttgagtttattgagtgggagatatgactatacaagtctaaaattgatcttgcaaagtgggtaggctgataactgtcttttttattttttcctattttgttgatgtgaaaactgtggctcacagaggttgcttgaatgaccaaaatagaaaagagccagggagatatagggctggtcttgaacccaagatgactacattctttaatctcttcattatctgtccacctactagaaagtcatattggaagtgatggatgccagctccccaggcgttcctggcctccttaggattggatgtatccagaaactgactagtgagcagcgcttttaatattttaattaatcattaactggcttgccctctgagcactttttgctcctgctttgaatttttagacagatggcaggcggttatttcctcagctttgtcatctttcacatggcagatgaaatatcaagcacagacttggagaaggatcataattcattataattagtcttctttgatcatttgtcctttgtcctaagtacagtagcaacatttaattgtggctgaagcattagtcaagagcagtgagcaaaatgctctctctctctctgtcttctctcaatatatgcctgagggcaccactgatgttgggaaaccatattctcagttggctttttaaatagctatacagcagcaagtggaaggggcgttgtatttagaagccatgacatgaatatggcctattttccttgatcatgttagtattgttaattaacatactgaccatttagtactgttgtgaggatttaggaaggaaaggagctaactaacattaactgatggcctcctctgtgcttgataatttactgatatgctctcactacctcttcagaacatgtcaaggctggataactgggcaaagtcatgcagctaccacatggcagagaaccaacccctcaactgcctgaatccagaacctatgcatttgtacaagcttgtttatctgcactctcttgtagtgtatttacttaacaagccaagttagattgtaatcgaaagcaggtgctgtcatatcactgcatgaatcttgaaaagcatggctctgagaggtgacactgagagtggcagttgctggataatgtgttgttacaaattaacttcttgccctgccaattaaaaagcactttattgaataaagtaatgatgctcttttatgcctgttgtgtgatttagattttagtagtcaatataattgtatgacttagctttcagtctttacactcacttacccaagtcttatgaatcaggtggggaaatgaaattagttccattttacagatcagagaattgaggctcagttggtgccactgctattgaaggtcagctagcttttaaataatcagactgtagacatgtagattcatgtggcctctcctaaataagatccaagcagtagcaaaaatatgaagacttaggctcaggaaaattttttcttagaagctgacattcagctccaagtcatatggttagggtttgcttctttccacttttcaatttctgacactaagtgataattatagagactgagaagcaccgagtgcatttgctgaagctaattgactcgatggggggaaggctgattgtgcagcggaatccaaactaccaattaaagaagaaggaaatcacatgcacatgatatcttggatatttatatcttggggaactaaaagagccagccttccttgccaccgtggagacagtctgagagtcaaagtgcccggccctggggtggtcagcttgaggcctgggtttggccaagaccgcagccagcagcaccctggtcagcagcttctcagcccctaatgagtgctctggaggctgtgcttctaggctaaaatgggaaatcttggcaaaggaagagattagattcaatgcacaatgagagaggaaatcaggcaaataggagctgcatcaatcaattaattatcagaaaaagggggctcagaatacactaataatgctaacttgtgtacagtgctttggagtttacagagtatatggctctctcaacagcagccacttaagaagcaggagtgtttcccccagcttccagcaggcaagtgcatgccctgcttcccaaatctcctgggcaagaggagctaggccaggaatgcaggcttctgacttatggtcatagctgccgagggctgcctgcattgatgggtcctgggggtggtagtagggagtagacttggtgtggtttgtagctgattctcccaggaactggtttttgtttgtttgtttctaaattctatcttactgaagagcatccctacagtggcacaccagagtggctgcaaggctaacgataatggggctattaactaaataacggtgctggcacaaagaaacagccatgctaggatcttaattaggctctggctgaagcagagatggagcacatttgcaagagatttctggttgactaatctggtgtcaaattaagagtgttctctctgggttgtctcaagtcagtcaccgtatgacttaaaaagttgtctaaacgaagaattccaagtgggccaatttctcaggagaagagaggacttgcttccccaagagctagctccctggaatagattagcaccaggatccctttgtcttcgttgactaacagtttaactttacaggcttctcagctgggagtccactgtttctgtcccactaataagggctgaagtctgtccggctgtgtacctgggttactagagctgaaaagcacttggcagtcctggatgggctgtttatgagtagttcttctatctgcagcagcagttaaatggttctgggaaatgaatcaggatcaaaggggagcttgaggccagggcccagaacctgggctcttagggggtggggggcagcagaacagaacaaagtagtagggaaagcatgatgtcacacggaccttgtatctcacgtgacctctgctcttcccactggttgtggggtagagccatcatgttaattctgctgggcctttttcaatacctttaaaatgggcttattcatttctatgtcatgtaagagtcatgaagtttggatgaggttagagtttatgactctagccagggacacagtaaatactcagggaacagtcgttgcttctggatctatccagcttctttagaggcctgatgtctctatcaggatgtgccttgtgattgcccaggcactcatgcctgtttagattgaggtcccaaccctcctgacttcattggctctgcccagtggtgcactcccttgacctcctctattcttgccgtcacttccaggcacctgtgtctggcttttctcttcagtgaataattcaaatcctatcatcctctgactattcctcctcttctcctccaacctctgtctcttctacttggtacagcaactctgactgcccttggaataacaccctccccagctcaaccactgcctgccagagtcatgaactctagaagcagattccaccaggctttcttccccaaaaagaatatgcatcacaagaggcacttgagtagggagaggggatctctgaagcaatgccctaacccccttctttggctttttgatggattatgttgggtggaaatcaacttcaacatccatcttctagtggaagctgactcctctgattgccactagggagataggggcttaatgaaacagaattattggactaggaaagtataggccttgaaatcgacctgcttctaaaggtaaacaggtaggcagttcaggccaggaagctggaagaagactggtaaataagcaggatgctgcctgaagaacccatgcagaaaggtgatgaatggagatccagcaggcaggtggggtcagcgactctggaaataaggacacagcattaacggtcaggccagtacccaagaaattagacagacatgtgctgctgagaatagggtgaatggaagcagagtctagatcctcaggttaaataaacgatggtcacaggaggaacatggcatagcctggaaggaggggcacacacgatgaggaggtgaggacaggcaaggggaaggggaaggggtattatgctgggtttcaggatttggggccctagtaccctgaccaaaaaaaaaaaaaaacaaaacatattggccatacatttttaagcaggcgaaggcgggtggacagggatccacaaagagcttcaaggatgtgcaagctggtaattccacagactgactttgcagagattctatcaacttatttaaataggggaccgttattgaatttttacctgttccccagcagatagaatcaaatgagacagcatgtgaaggagccctgtaaacagtcaagcactgcactttattgacaagtttatcctttatagaactgctggtgttctgtgagcccattattgtactcactaaatattagctactcaaacatttgctattatgatgtggcagggaaaattgtgaagtattaatttacatttatgcatttcctcttgcccttatccaaaaaggtagcaggctctgggcttcctggcctgcaatacacttctgttcctcattttatctcttccacgctgccaaactcatggtgaatatttaagaggcagaggccctctcagggaaacaagtaaaaatgggatatgttttcctttgatctgaagacaatttgcagtcctggaaaaggaaggaaggattttgaatcctgctgaagagggaacttgtgctctattccctggtagcagaccaggaaggtggcctgctttcagagagagaagactgtgaatccacaccaaggggccccaggaccctaagctgctggacaggaagggaacaagaggacaggaatagtagggcactcactggtgacttgtgacgatggatgtcctgtgactgatgagctaaggcattcatgctaccaaacagctctgggccttctaccactctgagacttaggggcatggtagaggaagggatttaagctcagtcataagtatatttgattttctttcctccttggtagagaaggatatatcatattaaatttaacttgattttaaggaaacgagtaatatggcctttgtgcccatattcatgttgtgtgtgtgtgtatgtgtgtgtgtgtgtattttgaaggtcatatattttgcataactgttatatgatcacatatctcctaagggaaatggaaaacatttgcccagcacctgctatatatgcccctgtttctagcacatcactaaggcaatcaatttgagacttcagaataacctatgaagtattagtgtcctctttatatagataagaaactgagttaaataatgtttaagtgattctgcactaggataggtggttagtgttagaactaggatttaaacccaggtcatgtgatcccaaagctcaacctccctccaccacatcacgctggattccccaagaaggaggaggttagcagtgatgctcctcccttgcatgagaagggtgggcgcctatggcaggaggtttaataactatgaactgtgatataaaataattctcttgaatttatatggaagtgtcagacctttagaggaagtgtcagaccttcagagggggcactgctgagaggctgaatcattgaggtggatgagattacatatgagagaccttcaatgtgacccagatctgttttattttaaaaaacagttatcactgtcctcaccaccatctccctgctgaccaccacctttttaaatctcagcattgaggagagatttctatggatacattggcattgtccaggagacaggtgacacaaaaagacctgacagatttctcctaggcagagaattatgtgaggagggtgttgaattacatctaggaatagaatagtctgctggcgctgcagctacagggaaatgcctcactgaatatcagcaggcactttagatctattgcatctaatggaatcttcagtgtgatttaaagaagtagatattctgatttgattcctgttattttggtggtcatggggaaggatggggagtgatattgagaggagagagagagagaaagaaagggaaggagggaggaagggagaaagaaaaagaatctttgtatttaaatcagtgacaatgggagaaaaaaacaaacaacattcctgatttcttgctatcattgagcataaatatcattatttaactcttatagctcagaaagataagctcccagtcagctaggttttagcttctttgtgaaatgaatgagctcccctgaagctcatcacatgcattcctaaataagtttgtaagggaactacagttattcacttggcctgttgagttcttttcattttgcttttcgaaaatggttcttaagtgaaaagacacatgtttattgcctccttcattctttccctccccttttccctcccttccttccgctttccttcaatttccccctgcttcttttcctgctatgaacacttattgaatgcttgtgtttacaaagcgttgagacaagtacaagggagatagtaatggtcagacacaaagagctcctggtgcactctgtaaagaaacccagatctgtagaaagttaaagaaggacccatggagcaagaggcatatcaaacagaacttaaaggtgagtggcacttcaggagacagagatgcctcttagtggtggtggtggtggtggtcatggtggcgtggtgttgggggaaaggttctgatgaggaatgtgcatgagaaaactgacaaagacgtacagttcagggagtgatcatggctaggccatggtggctagaataggagtgggtatgcatggcatatcagggaccaattgtgaaggtggagagccagcctctgagtacctaggagccaagctattcctctgggtacctggccttgccgaagatttctgagtacataggaagcctggcctgcatgggcatgcagacatgagctctgtgtgtctgaatgcacattagtacaagatgtttacttgatgttgcatttcagattagatggtgaaaatgaatggatattatcattattatttccttctaattacttccttagttaaggtcaaaatagagccagagatgatcattttttcccttgcatctttgaatgtgcatgctaagaaacgcaatgtagtggcaagctaatcgctttcatcccatctcacctagtcaattgtacaaaaaacttgccgtgtttctacttttccagactgtagaagagggaagtgctgggggcctctgtgtgtgctgctgtcaggtgggagccctccctctggcctctttataacctgtttctgagatgcagagctcaaatccaatgccatgtcaaggcacactgtaaaagaagggctttgggtttctgagctcccgtctaaacagatctctatttattgggattaattgatcattaatatttgcagtaaagatatctttcagtgagagtcaagaaacttggtagaaatcgctgaggccttgaagccagatagaggtagatgaaagatctgtcctcactactcatgctgtgggtaacttcacacaagtggctgaaaccctctaggcttcaattttctcctctcttgagaatgtattataaggataatatgagacggaatgtgtaaaacacattataagtactcaataaaagagaacgataattatttaacagtgttagctacagggacagaaatcatggagagttcaatagtactttgttaagactggaaagattctgcaccctcacaatagagttcgtcagaggcccatgactgcctaatggcactttgcaaagaaagctgataagctggaggcaggttccagcagtgcccagaactcagccaggttaaacagcaatgctgtgtctcagtgacaaacctcagtgtcctctggcaatggtcacatttgctgttagctccagctctggttgctgtcctgcctgggttcagctcagcaatccttttgcccactgttgtttccagaaacaagtctcagctccatttcccagaaacagtccttagttgaagtgagagcttccaaccctgcctcctcaagctcccctgccctactcagccttatcagggacctctgtttatacagctaacctgccccattccccagtctgctgtccacacaattccctggttctcccaggggcctggttctgcggctgtctttcttttttgatggtccctgcacctctctgtgcaagagctgacagagactccaggctcctctgtggtcctcttgttgctggactttttccttagttcagctaaaaacgggatccttgtcacatgaccatgaaagattaggcacacagacacttcgaagggtgagaagggcaggctttattggatgaaaaggggaaaaagggaaatagtgactctcagcaaagcaagagtcctgcaagtagacttcctacctcacagattgaaacccatttgaccaccctggaactcgagaggccaggcgcctctcccctacaaacggtccgaacttcccacggctccaccccattctcccagtgtgcaggcctgttggaggctctctggggatctctttaaacttggctgtctcactctctgttacctggttgcctgctggctgtcaacccacctgaactattgagagatcatgggacattctgaaggcatttcttaatgttcctcctctggcccagtttaaatgacatcttctctgcaaactatattacataaagcttttttattttaacctataggcttactttttctcaaagaaaaattgtaacataacttcagggaaaattaaaactgaaagaattctattcgtaatcaaggtttgcgactgggcacggtggctcatgcctgtaatcccagcactttgggagcccgaggcaggcagatcacaagttcaagacctgcctggccaacatggtgaaaccccgtctctactaaaaatacaaaaatgtggcaggcacctataatcccagctactcctgaggctgaggcaggagaatcacttgaacccaggaggcagaggttgcagtgagctgagatggtgccattgcactccagcctgggctacaagagcaagactccatctcgaaaaaaaaaaaaatcaaggtttgtatatttcttaaagtttggagccaaattataattgattcattcagcaaataaccaagcatctactgtgagggactgtgtatgagccaagtaggataaattacttaatatgagtggatggtggagataaatcatacttgaaattgaaaaaaaaaaatactagaacaaatcctgtctcttgctcctatgtaaccataatcctttaatcttcaaattaaccatggtcaaattcttaatatcttttaccacctataaaaagattggtcagtctttgaaaaattaaacagacatttgggtcccagagcctggggcattgaacacattttattcgaaataggttttgtatggatgtgtgcctattccatgtagaagcagacatagcgagatggagatacagcaaggaagccccttaaaatacactagttcaatgatgagaaatgcactttctgcaaaaacagcttcacaggtatataagtgacagttcggagtcctttgattggtgtttttgaaaagagagattgagattaagagaatttgtgctgatttccaatagctcttctaccttaaaatattttttatgacagaggctacttattacaatattttcaaatgggttatcaagcatcgccgttttatggcaattccccttcgggtatccctgtccaaataatgtgcatttctacttgactaattcatttaggaggacaacagacacctcaggggagacatttaaagtctttcttcagaaggactcccatgtgtggtaatgagagcatgttttccccttttctttcttctcttccattatctcagataacaggaattaattagtgtcctacagtcttttactttaaactccactttaagagactcatctactaagtgactttgttgttttattattttgttttgatttttcttattcttgaaaacaccagggctgcttctagaatttcttgaataagccaagccaacaataggcacaatgctgccttttctgtgggtaaatacccactcttcactaagggaaggggtgtggtgcagacattgtaggaaagtggtgctcattttccttctgagctgatgcacagtgcctgctgcagtttctaaaaacagcctgctaacataacaatataccaacttcaggaaaattagtgtgggctttctgtgaacacacccagttgttgacacactttctaaagcaatcctgtgattgtacagtcatggtgctagacagtgtgatgtctgtgcgcaccagcttgcttttctgcagtgttcactctatcaagctaaaatggagtgcctattcagaaccacgcactgagctgtgtgttttagtgggtgaagaaaggaactgctctttgccctttagaaatttagagggtgactagagttataaagtaaggaagaaataaatggattatagaccaaatgcagccagcgtcatggagaggtatagtaaatgtattaggggtgacaaaaattgtttttcagtttaaaagagtcaacagactggtgtcagcaagatttcccccatggcaacatgaaaacaaacaaacaaaccaacaaacaaacaaaaccagcaactagaaacggactaaaataactttgtagggactcggaaattggcaaaggtatacagcaaccaaataaacacccaatcatggaaaagccacattcaaaatgatggggagctttgtggcattttcacttgccattgcccctttgccttcccagtgtcgttcagcacagtatgagggagttggtggcccagtcctcagctcccttcggtgaactgaagattgcagagaactgagtttgcaacatcctaacttgtcttcaggctgcttgaggtgtcactaactcagtgtataaaagagcaaaactagatttgaccgcagtctgaaggaagccatgggaagcagtggtgatgcctcatgaaaactgcaaggagctacaaacgtgaagacccctgagacaagagattgcctgctgaggaatacaattgaacagctaaggcccagaggagaagtaggggtgtgactcttagataaaataagacatttaaaaactatcatgtatatgaagaattgggggaaaaaatgatgcattcacaggaccaggaatatacatgttcagaacagtccctcaagccttaagagaggactttaaggctttatgtcataccgatgagtgaatgccttcttctgcatggactatgtgcagagactggagaggtgtctgtgtctgttttttgcaagtactctattttctatgagagatcagagatatacaaagaaatatgaatgcatggtccattcaaaggaaaaaacaaaatccccagaaatagtctctgaagaaatataggcactgagcttactagataaagacttttaaatagctgacttaaattttctcaaggagctaaagaaaaacatgaatggatgactaaaataaatcaggaatattatatatgaacaaaatgagaatatcaacaaagagataatatattttaaaaagaagtaaacaaattatggagctaaaacatacaataacaactgaaaatttcactagaagggttcaacagcagatttgaagaaacagaagaactaatcatagaacttgaagacaagtcatttgacattattgaatctgaaaaagaaaaaggaaaaatgaatgaagaaaagtgaatggagcctcagggatgtgtgggccattaccaaggggaccaatgtatgtactacaggagtccaagaaagagaagcaggagagaaagaggaagatatcttatttaaagaaataatgactgaaaacatactaaatttaggaaagaaatgaatatacaaatacaagaagctcagtgaactccaaataggataaattcagagagagtgtacctatattaagacaaattataataaaagtattgaattcaaagacaaagaaagcatcttgaaagcagcaagagaaaagccaggtatgataattccttctaagattatcagcatatttctcttgagaaacactgcaggccagagggcagcgggatggtgtatttaatgtgccgaaagaaaaaaaaaaggaagaaaaaaaacttatcaaccaagatcttaaatccacagcctagctttatactttaaaaacctcgaaaaacagcaagaaaaagctagcagaaagaaataacaaagattggagcagatagacacaaaatagagaacagaaaaagaatagaaaaaatatatataaatgaaacaatgagttggttcattgaaattttaaataaaattgaccaacctttagctagattaactatgattgagagaaaagactcaactaaattcagaaatgaaagagggaaaaatactaacaccaattttattgaaatacaaataattataagacagtattataaacaatataaccaacaaattggataatctaggggaaatggccaaattcctaaaaacatacaacctactaagactgaatcataaagacatagaaaatctgaatggacatataattatccaagacattgcatcagtaatgaaggagctcctgagaaagaaaagcccaggaacagatggcttcatgggtgaatagaatagaaagccaagaagtaaacttttacatatatggttaaatgcttttctacaaagataccaaaaccattaaatgagaaaataacagtcttttcaaaaaattatattggaaaaattggatattcacatgcaaaaaaattaagttagacccttatcttacactataaaacaattaactgaaagtggatcaaatacttaaatgtaaatttaaaatgctaaaaatattagaagaaatacaggggaaaagcttcatgacattggatctggcaatgatcttttggaaatgacatcaaagccataagcaacagcaacaagaaacataaattgaactacatcaaaattaaaaactttcatgcattaaagaatgttatcaatagagtgaaaaggcaacccatggaatgggagaaaacatttgaaaattacacatctgataagcagttaaggtccaaaatatatagagttcctacaacttgacaattaaaaaacaacttgatttaaaaaaagagcaaatgacttgaatagacatttctccaaagaaaatatccaaatggccaataagcacatgaaaagaaattcaacatcaacaatcactagggcaaggcaaatcaaaagcatgaaaacatagtccctcacagtcatgaggatggctaatatgaaaaacaaagcaaaacagacaaaacaacaaaacaaaaaacaagttttggtgagaatgtggagaaatgacatccttgtgcactgctggtaaggatgtaaaatggtgcagccactgtggaatagtatgtcagttcctcaaaaaattaaaaataaaactactttatgatccagcaatttcacttgtaggtatatactcgaaataattgaaagcagggacttcaagagatattgatacactcatgttcatagcagcagtattcataatagccaaaggtgaagtcaatccaagagtcctttgatggatgaatacatgaacaaaatatggtatatatacacaatggaatattgttcagccttaaaaaggaagaaaattcgaacacatgctacagcatgaatgcatcttgaagacattatgctaagtaaaacaaacctgtccaaaaaggtcaaatactgaatggctctccttatatgaggtaccaaaagtaatcaaattcatagagacaaagagtggaatgttggttgccaagggatgtgtatagagggaaatggggagttattgtttgacagttacagatattcagtttgggatgatgaaaaagttctggaaatgatactgataatggtcacacaacaatgtacttaataccactgaagagtatacttaaaaatggttaaataagaaatttaacataatgtatattatactacaataaaaaatagtaaagttttttgaaaagaatcaaaataagccttatggaataaatgtcatttgacacgtgagttccgagttcatccagttaattcatccagactttcccttttggaaaggatggatgacaagtctggcactacttctgggccagggtgaacagcagaatctgagtataaaaccacatgtgaactagtgctgcagaagctgatgttcaaaaaggtccataaaatcaaaagagaggccaagtgtggggattccatatggagaaccatgaggactgatggcaaagatccccagaatgcaccaggagaataagaaggagaacaagaacctcaactgtgacctgagacatgggaataccaaatccacacaaggagttaagggaggaaatgtcaagtagggtctcacgagcagagttgggttccagaagaaagaacatgaccaacgcagtgagatgagaaataggtttattgagatacataataataataatgccaacatagaccactaagggctttaatgtatatgagcacagggacccattaactggattgtattattatcccttttgccattggtaattttcctattatgtgtccgagcaagtatttgaacccaaagacctcagagcccatgcccttgaccacttatgctatagagagagaattagctgagtataacacaaaacatgaagtcatttgaatcacattttaaagggctgaccttcagatggtggcatttactgggccttgtggaaccttgatgttttttagcaggcaagagatgagaacagaaattactctgggaagacaatttggcaacacagaaatgaaataatttgatgaatgtcaaggctgaaattagggagatcagttagggaacatagaggaataaggcataaaccgaggggacaggaatggaatgtgtggactcaaaaacctttgaggaagttgaatcaagtggatttagctactaattagctgaacagtgccaagactccgggagagtctgcaatgactctgggacatctgaaactatggtgaggccaagtgtgcaatgatgtaagcagggataaggaaaacgggactactctgtggtggttggaattaattgtcagaaatccccaatcaaatcccctctgggatttgaagaatacatttttaagatgcataattagtctgaaagtaataacatgaatcctaaaatgcttacgaatccctttactaccatggatactaagctctttaatagggcacaagaacctctgttaactgggtgagatttaggagttcagcaatcacaagacagctccagctatttgagattatgctgagtgttggcttgtgtcactcttttttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatcggaaaggtggggaaaagattgagaaatccgatggcttgtgtcactcttgaaaattactttgaagtcttttagacttatcctattatatccttttatatgccacgccagttgaaacttggaaataattaaaaacaatagacaagaacctgctaatcttttatggtattcttctatttaggaaataattgattgggcgaagtggattacatttcaatattcagacaggctccttttgttattacttttgactctatctgctttttaaattaccttgcctattttgaaagcacagtacagttttcttatgtttctctttttggtgcaagacaatgtagaaaggctcatggtgtaaaggtgaaggatatccactatccaatttaatatccttacatgactaacatttttagagaaatagtcctttgaaattaataggaggtgatgtgacagtggaaaaaaatgtaaaaatcaatcagacttgattttcaatactggtgctggcacttaagagctttgggattttggaaattgaattaaataattgatcctcaatttctttgtctgaaatataggaataaaaatacctttaactcagggttattatgaggtttggtacatacgtatatttatatgtaactatatgtatacacacagacatacacatcacacctatagacagagaggaaggggggaagagaggatatgcacgcgtgtgtagtcttggcacatagtaaaaaaactggccgggcgcggtggctcatgcctgtaatcccagcaccttgggagacagaggtgggcggatcacctgaggtcaggagttggagggaaaaaaaaaaaaacagctgggcgtggtgatgcatgcctgtaatccccagctacttgggagtctgaggcaggagaatcgcttgaacccgggaggcagaggttgcggtgagccgaggtcgcgccattgcactccagcatggacaacaagagcaaaactctgtctcaaaaaaaaaaaaaaaaaaaaaagcccggcaccggggctcatgcctgtaatcccagcacgttgggaggccgaggcgggcggatcacgaggtcaggagattgagaccatcctggctaacatggtaaaactccgtctctactaaaaacacaaaaaaattagcggggcgtggtggtgggcgcctgcagtcccagctacttggaaggctgaggcaggagaatggcgtgaacctggagcgcggagtttgcagtgagccgagatggcgccactgcactccagcctgggctacagagcgagactgcgtctcaaaaacaaaaacaaaaacaaaaacaaacaaaaaaaccttaccatttaaaaaacgtgttctgtcctgccctaagaaagaatgcctaatgtttttgaggttcatctgctatgataaatgaaagaagccaaactcgaaagattgcgtattgcaggatttcattcataagaaaggtcaaaaattcacaaatttaattaggacacaaagtagattagtggttgtctaggattgggtagtggggttgataatggcaatttacaagtataaggtttattttctttttgcagtgggaaatatcttaacattagatttgtggtaatggttgcaccactctgtaaatgtactaataatcattgaattgcacacattcaacaggtgatgtttaagctatagtaattacatcaccaaaaagtcattttaaaataaaaaggatgatatttctgtatactaagctgactatcctaagtaaaataattggtgcttatgaaaaaaagaaacattatttgtgctttggggttaaggaagtctctcctgtatttgtctttaaatatttctttttgtgtgttgaccatttttttggtaataactccccaaatcagagtggtatatgagaatcattttctcatttacattacatattggcatctattcaggtctgtttgtgttttgccagccccactctgctctgattagctctggtccacacgtattcatacagcccgtgcatggcacatgcttattctcatggcacaagagaaaactaagccaaacctattagcacttaaagcttctgcacagatataccctgtttcatagctgcttccgtgtcattggctaacgcagctcacatggtcaagcctagtgctgatggaagtaaacttgcacttctaccatggagtgaggggattatgaatatttctgaacaataatacaatgagacaatctaccagtgttggaggacgatttggctaacatcctgacttgagcttaatcctctatcagtgcttcccatcccttctactctcttactatccaaagtatatctcatcttcctcttttcccactgggatttactgtaaacccttttctcctccaccatgaaaaactctgccaaggagcttgctgtcattcccagctaccatctcatgccttccatttcttgtactgccagacttcacaattatgaccaattggtgtccttactatttctctatcatacattgtttttatttctctatcatatttaactgcgttatgacttgaaacttctcaatccattggatttactctttctaaagcctctaatggccttagttgccaaatccatgacatttcttcagccattatttattttgatggtagtcatatttgtaccgtgaactcataaagtgcagcgtgtctgatcccccttatttgccaggttccacattcttctcccccacacttccttcctgtgtgatctggtatagtcccaggttttactttctgagagtgtgactcccatattaacatgtttatttctggctttcttaagtaagaaattaaagggtcaaaatgattactctatttaattaatcattcatttacatattaacattgctaatctgtttttgaacaggatggaaacagaaaacacttctctgggaaatttaaaggtaatcttaggtttaataattctattcataaatattactgtatgtagttgaaattagttcacaaattataaattacaattctaggccgggcacgatggctcacacctttaattttagcactttgggaggccgaggcaggcggatcacttgaggtcaggagttcaaaaccagcctggctaacatggtaaaaacgcatctctactaaaaacacaaaaaagtgagccaggcatggtggtgggtgcctgtaatcttagctactttggaggctgagacaggagaactgtttgaacccgggaggcagaagttgcagtgagctgagatcacgccactgcacttcaggctgggcagtagagtgagactccatctcaaaaagaaaaaattacaattctgtagtagaaatacagtattatgtttcgaagcacagcttagctcaatgcctgtatctagtgatttttctctccatttttaaaaccaaacatatacaaataggaaatattagggattatacgtgtagaattagatgtgctctgtgaaaaaaaaaatccacatgtagaattatgcaaaatacttgggcaaatgtaaatataccacaactgtttttattaaatcactatttttagttatcatgttgtctttatgagcattgagcacacttagtagaaaggctgccacactgtgtttagccttgtcatcctggaacaagatttttcatcttgaatagtctgataccaagactgaacccatctactgcaaagacctgtgttctgggaacgcaaagaatattctgacccccttttccagtattgagctgaaatcacaaagattttgtggtatagtgataagagctgtaagatttgggtttctattcctggcactaaccttggagtacggggacttgggagaggtgtggtgtagggaaacaggcaaggtcagtgctacacagagtgtgattcttggataggcaccatcaaagggaccacggagcttggtagaaatacgcatttctaggtttcacccagacccacccagacctgctatatcagagtcttagggttgagggccagccgcctattataaccagctatcttgatgtttcaagtgcttattaaagtttaggaagcacagggatagtcatctctacttaggcaatgaggttttgttaatcttcatagaggtgcaattatgggaggaaaatggtagtgagtaggagattgtggttgataatgatgtacctacaggattacagtgtgggggcaaatgagagagagtcataaatacagagtctgagtgaaccaaaatgagccttggagggagtaaatcttactgtagacaagcatcaagtttaccaaccagcacagatcctacaatcttgcaaggatgcaagaattttcttaaatgggttaacaagtaacttcagttcaaaaaattccaacattcaaagtttctgtccaggaaaggcagggcagatgggcccaaacagatgaaaaaaagtaatttgatgtgggggatttctaggaatatatgcactccctacttgtccatgcagaaccttattcagagaccagcctggcctttgctagagaactggacttcaaaattgaaagggactaacacaatgatgatgcttttattatggaaaagaaaacatgatttgcatacagagtcaggtgagtgcagtggtgactgggtctcccagatggaggccagctcttccttctgccctttaaagggtccagcaacttctgactttgagctctcaaagcagcttccttgcttggtcatctcaaactccgtggacctttgtagaactgagaaaataatctggctttcaaatggtaattcttgtatgttttcataaagatgttggtgatgatgacatgatgttgctgatgatgtaaagtaggcaatgctagtagtagatgtagtaggtgtttcccctctgtttaatgtagatggcttcccagaaaattgcaatgtagcttttcacatttcacacacaaacacacacacgccaggccctattccccttttaaaaaggttttcctctctgtcactaacggagatttcctagaatcacaacttgggttggaaaggagggacatcaccagttgctcaagtttagttcatgggaaataatctctggctaccccagcacctgagcgtcctggtggatttcatgactgtatgcattgctcttgatttgcctgctagtgtatgggcacaaacaagggtttggaatttagaaatggcaacaaatctgccttttaactcttatgactacttctaagaaaattaaagaaaatgctatatgcattagattttaatttgcttttcatattcagagaccatctggaaatgtaattatagttcaaacttttaatctccagtgcctagacaagctttttaaaattgtatttgaatctgtaaacagacacgctggttttttctataatggcttatttgttttgcaataaaacagtgtaatgatttaaaacagggtcgcatacctgcccattcccacctggactgacacttagaatctgggatacatatggatatttagtgaatgagccaaatccctgtttttcattcctgacttttaagtacactttgtgtactacagtgggtgagacgttaagtttcagaattaatctaagatggttctgaacccaggtatcaccacattttggctttgtgtccttggccaaaagatttaacctcactgagccttggtcttattttttgtaaaataggagattataatagctttgtccttgggtttgttctgaagactaaatgagatgatatatgtaaagaatttagtactgtgcctggcacaagtcaacaataacagttttgttgtcattactgttattgttttaaagttgtagctactatttattgttattttattttaaaaaattcttgtctgtttgtcccttacataagctatctttggcattaattacatctacaaattcccagttgtcacttgatctgatttgctttacttccaatcacagtggtccctgctctttagcatgcagggctacatttgtcagtgattaccttatgaaataccctggtgcaaagccagaatttaatatgaagatcttgtcaggagagctacattcctagtacagtcacaatgttggcaaagaatatagttggactagaggactttttagatctttccaggtctgagatctgggacttccagagtctctaatctccgtaaagagaacagtaatgtcttgtcccatttctgtatgcaagagtgatgtatgtgattctgccagctttttccagaatactcactactagtgactaacactttttagtgttaaccatctaaaagattgggaataatgtcagtttgcatacctataaagtaaaaatgataccatgggaagggtatgctgcagtatgaacaagataatatgtttatagcacccttcacaatacaccttgctccatgctagcacggttagacattgtctctggaatgctactgtgatacttgttcattacgaccccagtgtagggctcaggaacttaactacacaactgtgtccccactataaccctgctctaaccaaatagtcttacaagcctccaatgccctgactgaattcaaagatgagctgatttttagataaacttgcaaaggaatataaccttaaatgatctcctatttataatttataaaacacacttatacaaattgataatgatgtatgtttgaataattcaagaaacaggatgtcaatagattttagcaccaagtaccaagaaagcttctgcttgtgaatattaatttgactaatttgagatattaggccatctagtatggtaagcatatttgcagagtagtaggattttcgaagggtaatctaatcagaaatgggccaactagcatttgtaaaaaatgtaacaattacctgaagatctcatatgagatattttgcaactggcaaagagcaagataccctaagtaaaatgtaactgagcaccaaattaaatattgggaaaatgtctggaaagaatccatagtaagttgctttgttttgtactgtgctttcctcctatttatacaaatacatttatagatgagtatagacatttatagtctgagtagtttcatttatatgaccacaaaagtacaggcagcaaaagcaaaaaaaaataggctggtgaggcttctgtacagaaaaagaaacagttaagggagttaaaggattacctatggagcaggagaaaatattaactgctctatatctaataaggactcaatatctaaaaatgtaagaaacttctacaactcaataacaaaaaagtaataataacccaattaaaaaatggaagtggacttgaatagacatttcttcaaagaatgcatacaaatgtcccacagatacatgaaaaggtgttcaacatcactaatcgtcagggaaacgcaagtcaaaaccaaaatgaaatatcatctcacacttctgagcatggccattatcaaagaaacaaactagcagaaaataacaagtgttggagagaggatgtggagaaattggaacccttgtatattattggtgggactgtaaaatagtgcagctactactgaaaacagtatgaatgttcctcaaaaaactgaaaatcaaaataattgaaatcagtttttcaaagagatatttgtactcccatattcaatgaagcattattcatagtagtcaagaggtagaaaaagcctaaatgtccattggcaggtgaatggacaaagaaattgttgctcatgcctataatggatttttttttttttgagatggagtcttgctctgtcgcccaggctggagtgcagtggtgcaatcttggctcactgcaacctctgtctcccgggttgaagcaattcttctgcctcagcctcccaagtagctgggattacaggcatgtgccaccccacctggctaattttggtatttttagtagagaagggtttcaccatgttggcgaggctggtctcgaactcctgacctcgtgatctgcccacctcagcctcccaaagtgctgggattacaggcgtgagccaccacacccggccacaatggataccatgagatatcattcagccataagaatggaggaaattctgtcaaatgctataacatggatcaactttgagggcattatgttaagtgaaataagccagtcacagaaggacaaatgctatatgattccacttataggagatctctaaatcagccgaacccacagaagcagaaagtggaatggtacttgctagggcctgggaagggctgatcagagtatagagtttcagtcatgtaagttgtaaagttataaagatcttctgtaaaccattgtgcttatagttaacaatactgtactgaacacaaaagtttaagaggtttaacataatggttattatatatgtataatatatgtatatataatacactatatatatctattatatagatatatctattatatagatatatatataatttttcatcatcaatgtgctaaatcctgaggatacaaagaataaaagtatattttgctttgttcttgtaacataaacctatatataaataaacagaaattgtaagtcagtataaaagccagatacttcatcgtcctgcaagtatgtaaatgcattttaaaatgaacaccttagaaaggggattgtggattcagtttccagtgactaatttatgtctacattgggaggaatgtgtaagtctaatacacgctttctatcattgttttattttaatcctccacacaaacttgggtaacactattctgtgaaccacctgagggaccagctttgtaaccctgagtggaggttaatatatattaaaaaatagtgttataatgagtgcactccagtctccagaatccaggttaaacatgtcatcatgaccagaggccattgctaattttactttcatgtgaatctctttttaggcttcacatctagttgggattatttagaaatgaccaagactacaattattatacacagtttattagaaaaagaaaaggcatttgcctttatgttattgatttatttacttgtgttagttttaagaaaagacaaacagatcagatatagaaacacagcaatgctattttctatcaaattcctctgggtgtctcatgaaaatcttgcatattgaattttaaatccaattcgtgcagcccagaatgacatttcagtatattatgagttgtagtcaatatattgattacagtctctttgggcttacaatgattaaagaccatcacatggatacagtatttgtttagcagacaattctcaagattttcatgtgtgatacagaagccctaacaattatattgtatgtgtgccaaatgtttttcaaggctattgaaaataagaaaatttaattaaaatggtgtgaattcatttaaatttgtatggagagaatgggagatataattatgagcctgttcttggttgtttattgcatgaagttggctacttggtaatttcaagaccatggtaaaccagggttattttgaagtcatcaacaagtcatccttggaaagaacttccaattcttaagcaccttatacctgcctggtatgctaaacatacaaactcatttactcttcacagccatcttccacagaaatgttattatttccaaatgtggaaactgagacttctagaggacacgtagtttgccaaaggccacacaaatccagtagggctgaacttagaatgaggcctccaaaactgcaagtaaaatttaaataaatacaaaataacttactttgattaaatctggactacattgagaaagcccttgttttgtttttatcacacagctctcataaaattattattattttttaattgcaaagtatgctaagtacaaaatggtagctccaactttagtctgaataactacaatctccactgagggatttctttccaacaacagtgttccatggaagcagagatgacttttgtggtctcaagtggacttggccctcaaaggggaagctgcctctgagggtggggttattcactccaactctgggggctgtgaagccatctccagggatggcatgaccagttgggtcttgaatggagagttacataaaacctcaggaattaatgatttaataccatattctgtatttattttcttattttttcatgaagatcttcataccatagggtctcaaatatttaggaaaaaaaatgtttggattaaaccttctatcacattactcttgccttgaattgtgaatttttaaaaatgaaatttcagttgggatcacttttgtgtccagttacctaatatatatataggcctaatcaataataaacatgactactatttatgcataccaggtgctctgctaggagcttttgtttaattagcccagtacactcacacagcccatatgagactagtattgtaaaccacatatacagatgagataatgggggtttagaaaagctcattagcttgcctaaattcaccaactagtgtgattaaaattggatgtgaatgcagagctagttgattcggaaatgggtgctttaataatactattcagttcctatattttttaacatatccccacatagtgtattaacatgttcttagagatatatggagaaggaaaattcacctaaaaatctataccagggaacagttagcaatctttgtttaggttcatctgaagtttctgtaggcagttttctggaataagcttctctatggctggtattgcatcagcagcagtttcaatagggcagtctctgtgtctagagctcaagaaaatcagagcctgggtcatggtaggtaggcaaaggctgaggcagcaatgtcactcttaggagggaagcaataacctaagccaaataaatggtcatagtacaccctcaacctaaggtattgtcacaaacagggggctggagcctggattcattcatcaaagagcatgcctgttgattgtgcagaaggcatccattttagagaatttggatctttgagacatggtagagcaaacaaaacaaatgacatttatttcacacttgatatatgccagacattatgccaggcaattcatttgcacaactttattgtattcttatcaaaatctattgaaaaaagtattgttatctcatttcaagatgaagatgctaggacttaaaaaaaagtttttggatcaacattatacagctactaagcaagatactacgatataaaccctttctgtgcatctttccacagcccagtgctgttttcctggagattgctactgaaagtcattttcaacctcatacctggaaagatagggaagccaaggcacagagaagatgaatgatttctctgaggtcataaaactattaagtgccagaaccaggttttactgccagtctatttgatttcaaaattatttcaattagatcattgccatctctatgttaatatatcgttaatccttaagaaaactgtcatctgacccaaactcccacaccagcagccaacttgcttctttgcttctgttgctgcaaaactcttttaagatgtatctacactcaggttggcagttcctctacttctggcagccagttcctctacttctgttctcctaactttttcagattgcttttcccctctcatgctcatacagaagtcatccggatcccatactgctcaatcgatgaccaattcccagtcttgggtgatctatcagcaaggccatcttgcccttctattgggtaaactttgttcaaatggctcctagtgtcatatatactcagtctttctcctaccttgctgaacaccctttcttacttctctccaagctcttcacacaggagcatcttttttttgatgctcttgtctcttgctttctcctcatgactttggtgaatttatcccatgttcataactctatgtatcacctacatttcaacaacattaaaaattatagcttcagctgagacctgctttccaaactctagacttgtatttgcaaatgtctaccttatatccctatttggctgtctaacagatatttaagacaatatctccagtacttgattcctattcttccctcaaaacctgcttcaccagctgcctctctcatctcaagaatctgcatctttctcattattgctactgttaacacactgatccaaaccattatcatttcttgtctggattatttaaaataaataataaaaaactaaatatttaatgggatttcctacttcaaactcagttcatctagggtctgttttcaatatggcagccaatatggcagcgtgaccaaaatgtgtcccgttatgtcattcccattctcaaaaatgacctcaccatctgactcagaaacagttgaaacatttacaatggtcttcttctgagctcctctctctttctctacacccatcataccatcacattccagctgtaggatgttggctgtagaattttgcactggttgagttgccctatccccagatatcagctttaataactacctcatccttttcaagtctttgtccatgttttacactctcagtaatccctactctgaactatctaacgaagtaaactgcctgccatcttattttgtcctcctgattctgcctatgctgttcccataaaatatatatatatatatatatataaaataaagatgcatcgctttctaacactctagataatgtgtttatttagcatggatattgcttattgttggttttctcccctagaatgtaaataccacaagggcataaatttggtctttttaccactagtgtattttgagcacttaaaacagtgcctgagacataataggtcctcaaaaaatacttgttgaatgagataataaaagtaagtatattgcagaccttttttagccatcttaactttgcagaaatttaagtatctaatctgaagtatctgagggtacatttttcccctcataatctctgctatttaactagtgtctaatttcctaccaattagtctatgtaaatttatttcaggcttcatataaaccactgagcagctcaatgatattgatctttactgccatttaatggggttggtcagtgatcaactccaggcaagaccctgaatcagcttttacttatctgccctctggcatgtaaataagtggacaaatgtctgcaaactcatgagacccttcctcttttccttaaatgttgtcatatgcctatctgtgctctttctttggttagaaaaataaagggaatttaaaatctttggaataacaggaagaactagaatcattcataagtattttcttcaactttactctaattgccctaagattaatctcttgttacaacagcaaagtctagcctctctagaattccttgaacactgtatttcaataatttgatcctcatggacagtgaatctatctgtcacagtcagttgtcctttcactctttgaatcaattggcgtttacccatatcaaactctatttgtccatcacttctaaaactcttgataatttccaattgctcatggagctgagcttgaaggttgacatggatcatccattctttccagaatgacaaatagcattacatggtgatcctcacattttatcttaatttcttggcaaatgttaatttaattttctgctaaatggtttcaatctcatgcagaaccaaagtgaactaagttaactatctcagaaatatcccctgtcttgtcaggataattatttctttcatttaaatgaaaattaagtaacactctctggtgatttttttagatcatcaacataatttctgatgtcactgtgaacctctgagacacgttaagcttaaatttccccctaggctcaaagtggttatatgaatttacttgttcaaaagagattgcatagaaacctaacacaaactgacggcatcttggagctaaaagtagtcttaggtattatgaaacccagtcataacagagtttgcaagtagagaaactgaagctcagaaaggaaagttgaatgtataagttcacattgcaccaaattgggcagagacgaatagcaaaccttggtcttttgacttagtccaataaagctataaaattacatgcaaatgttggtgaatatttgcagaacatttgtttgagaaacgtgtccttagcaatttatcacaaaggtcagtgatctctctaatgttaggcaccaaggtccacttcactattttacagacacagttggcccagggtccatgtaaagttaatccaagaatccatgtaaaactaaattgagctttgtattcagttttaaacaatagtaacttctttcttactaatgagcatggatggattagttgggtatccctgctggggcattggattgctgtgacttcagtgctctctggaacaagcgcagtccaggtgcctgtgtgtggagaagataaaacacttgatgttcaggtttgtttttttttttaatttcaatttttattttaagttctgaggtacatgtctaggatgtgcaggtttgttacataggtaaatgtgtgccatggtggtttgctgcacctatcaacccatcacttaggtgttaagcccaggatacactagctatttttcctaatgctctccctaccctgacctaaccccctaacaggccccagttcgtgttgttcctctccctgtgtctatgtgttctcattgttcagctcctacttataagtgaggacatgcgatgtttggttttctgtttctgtgttagtttgctgaggataatggctttcagctccatccatgtccctgtaaaggacaagatcttgttcctttttatggctgcatagtattccatggtgtatatgtaccacattttctttatccagtctatcactgatggacatttgggttaattctgtgtctttgctgttgtgaatagtgctgcaatgaacatacatgtccatgtatctttgtaacagagtaatttatattcctctaggtatatacctagaagaaaatataggaaataccattcaggacatagggatgggcaaagatttcatgatgaaagtgccaaaagcaattgcagcaaaagcaaaaattgacaaatgggatctcattacattaagtagcttctgcacagcaaaagaaactatcatcagaggaaacaggcaacctacagagtgggagaccatttctgcattctattcatctgacaaacatctaatatccagaatctacacggaacttaaacttacaacaaaaaacagccccattaaaaagtgggcaaaagacatgaacaaacacttctcaaaagaagacactcatgaagccaataaacatatgacaaaaagttcaacatcactgattattagagaaatgcaaatcaaaaccacaatgaaataccatctcacaccagtcagaatggcgattattaaaaactcaaggtacaacacatgctggcaaagttgcagagaaataggaatgcttttacactattggagggaatgtaaattagttcaaccattgtggaagacagtgtggcgattcctcaaggatctagaaccagaaatatcatttgacccagcactcccattactgaagttcagtatttctaaacagagaagataattagttttttatcttctgttgacttctacctctcctccgcaaagatttcaattagtaaaaataaaagctaacacacacataggtaagaaaactcaaatacgatctccttttgcaaaatttttattatgagattttgaaataataggacgtgtgatgatatgtaaattccttccactatagcttttgaggttgtgtgtgtatgtgtaagtgcgaatgtgtgtgtgtgtgtgtgtatggatttgcgtgagaattagatattaacattaaaaaacttatttttccatcatatatcagaaaacatgatttttaataaatgtatcatctaatatgcaaagatgtattacaagaaaaaaattaatatgcctgctttgccactaaatccatcacccccaggcattctcattctcccttctaaagcccatttttcatctgtaagtgaaagaattgaactagtttgctaagaccctttgttaataatcagtgtgtatgtggtgacttgctactaaactcaaactgcaggtcacctccaccattttctgagacagaaattgtatgagcagtttttttgcgtgattgaaaataatatatgcatgtgagacattggcagctaagaacttggctattatatgcatatcagacaccgtgataggctgatcctactctttcttttttctttttttttttaatttttgagacagtgtcttgctctgtcacccaggctgcaatgcagtggcacgatctccactcactgcaacctccacctcccgggttcaagcaattctcctgcctcagcctcccgagtagctgagattacaggtgcgggccaccacacccagctaatttttgtatttttaatagagatggggtttcatcatgccaggctagtttcaaactcctgacctcgtgatctgcccgtctcggcctcccaaagtgctgggattacaggcgtgagccactgcgccaggccgatccctgctctttcttaatcatagctttgaacagttgtagtcccaaggctatccctcttatggttttaaagttgacccttctggcattataataagttatgcactctaggatttttcattgagaaaagactaagaattgattttaatctcagatcttacagttcagcaaacagctttttcctacttgattttttttttgtcccatatccctttcccatgcatttctcttttgctcttctctcccttccatttacccaactaggtctcacatctcagaatcagatgtaatagatttttgtgtttccacctagtactgttttcccagagtaatctgggaaagttgggcacgcctagcagacaacatagactttgtggaatatccttcttccacaacttaaagggtcttctttacaaaattacaaatctttacaaaattacagttaaaaggtcttagcagaagccctaagaaagtgggagcccaaagggtaagcctcatcaaattcctggtaaatccatatatgtccatctctgtctggctgtgtctacttttgtatgttccaatgttttagagtgcagacacacacacacacacacacacacacacacaaagatgcaaaatgctggtgtcctgccactttctctttggcagaatgtgagactaaaaacattctcagtgagttcttgcctaaagaatgtaggactattttgaaggctccagaggacaattaataagattttatttttctttttattagaatttacatttattgacgttcataaagaagctgataactgcttagaatatgaactcagatatggtctctctgacaagatgccctcctgcacaaaatgttggcattagcattatgcatgcaattgatgtgatatattcagaattactctgaaagaaaagaagaaaatgttaaggagactgatacattcaaacaattttaggtttgtaacatggttgttagcgataaaatttgaagaagaattaagggtgagagaaaaagtaattggcctccagtaaacacctctcactgccagtacaaggcaaggagacaaggtcagcattcatatttcataagcctagtaataacaccactgtaatctgcacagctactttggatgtgagatgatattctatttctgggggagtcagcttttctttatgtacagtatctctcttttcccatttaaaaattatttccattcattaaaaaagagataaaagaattacaaaactacctcccttgttcccagaactctctattgacatgattgtttatttctctttctgcctttaatgtctttataagtatttatttaacttatttgagaatatattgtctatgttttatcctgttttattctctttacatatttctatgctaacattcctcattgtaaacagcctttttgcagatgtttaccttaaatatcaaacaccaaatatcaaagtttactaaacttttcctcccattgttaaatatctagattaattccaaattttcttcattaaacatacattgccgtgaatattttctatctaatcagtttctttattttagattacattcttagaatatattcccagaagtagaattagagactccaaggatttgaatcttttaaaaagtgtttttaatacatggttccaaatctcataccaaatggaatacattgattttcatatttaatatctaaatttgtgaaatattctgctgaattaactttgatttttttcccgtcagtctttaattaaaagttgctgtctctctcagttacaggactagctaccagatttgaactgactgccagtcattctgggtaaaagcgtcaggtttttcttaactctgttgagtatatatcctattcaaaaaactgagttttttgtggggcaaataattagcatgaaatgcaagttggctctcttcatccttctcgttaaatcttgcataccatcttaaaatacttgaacttttctttttaatccataataggcaaaataaatactcaaattagcaaacaaaaatcaaaataacagtctttataaaagaatagtatttcaccatgattaacattttcatgtgtggtgcacacttatacaaaatgagtttttgaaaattttattattcccctgcagccctccagcccagaataatcaccattctactctctacttctcttcagcttttttagatttcacgtataagtaagatcataaaatatttgtctttctgtgtttggcttatttcactcagcataatgtcctccaaggtcatccatattgttacaaatggcagaatcttcttctttttaaaagctgaatagtactttagtgtgtgtgtatgtgtgtgtgtgtgtgcgcataaaatagaaccacactttcatgactcattcatccatcagtggacagttggatcatttccatatcttggttattgtgaataatgttacagtgaacatgtgggtacagcaatttcttccagatggtgatttcattttctttggatatatacccagaagtgagattgctggacaacatggtagttctattttcaatttttaggagcactcatactgctttttcataatggctataccagttctccccaccaacgatagacaagggttcctttttcttcacattctcaccaacacttgttgcctcttgtctttttcatgatagccatcctaacagttttgagatgatactgtggttttgatttgcatatctctgctgactagtgatgttgcacatcttttcctatatctgttgatcacttgtatgtattctttggaaaaaaatgtctgttcaggttctttgctcattttttaattgagttatttggtttttttttttctaatgacttgtgtcagtttttaaaatgtattagatattaatccttcatcagatatatggtttgcatatatattctcttattttatagcttatcttttcatttcattgattgtttgctgtgaaaaaaaatccatcattaaggggaaataaacaagggtgatttttttctcactttgtgttgatttttttttgagacataatttgagttgtacatcactaattagaattgagataaaaagatggaagaaagccacttccacagcacgttttatatgaactcgcaggaagcagaagtatgcagaagttagaagaggcaccttgagctcaaaatgaaaaaattctgtcttttaaacatcactgcttgtcttcatcagaaaccaaatgtgacttcttggtagggatgttgtaaaggggtttaccattggtgggtagatgaattccatgaatttaaaattgcttttcacctttgaaatttagtgagttcattacagctgggaggcagacctatgggattcataaatggctgagaagaaaaggacatgagattactaggagaaaatacactctgatggaagagagagtcactcccaaccgttggctcaggagtaagctttagttgtcgatgaagaggagtggtttagagaattgcctgttgcctgtcactcaatgttgcctcaacccaggtattcatatggcactgtgggggttcttgagaaagcataagcaaaaacttacagaatttttttcggtaaaatcctgtaagccattaaggtacacagtgtattatgcagtaaatttaggtcacccatttcatggcccacagctcagtttgggaagcttgtagactccagatgagactccagggcatcaacaagaaagcatgatgaaagcattgaccaagaaaggtggaaacatattgagtagcaggaaccaaagcccatttgaaaaggaaatgccattagacactggtggttctcagtggaaacacaaagatgccttgagaagaagagtctggcctagtgacaagtgaggagtactgaattcagctggaaaaagaattctcttttttaggcaaactccataccacttgaggcaaagagccaacatgtattccctacaatctgagctgtaactcagtttgcttttgttttttcaaacagttaaaaagagacttggctggtactttcaaaggggaaattgagataactaacaattttggagaaggaatattgcattttcaggttcatttactatgaatgcctaccaaagcaattacagacaaacctttctttctttcctagaagataataaaaatgataattagcaatctgctccttcatttcttcacatgttcttgaccttgccttgctatttagggcttaccatatacagatgatttttagaaagaatatgatttaatttcttttagaaattaaatttctaacatttagaagcttcgttttcttaaatataaatgttttttcaaatggtctcaaatggtctctaagcaaaaaataggacaatagaaaagacctctgttgctactgtttcttacattctgggaagttatataagctgaatatgtgtgaattgaatgatatatctttaaaatatttattggttaggtataagttataaatcacccataatagtttagttaaatttattttacttttatgattatatacagggcaaactagagactttgaggtgtgaaaaaccttcaggtaaattctcactccacggtgtacaggctaagcctcagcttgaaagttgtgataatctaacaaagagttcttgtgaaggttaaatagaatgaagactagaaaacatcttgtacaaaactctctgatttcaagtagccttcattgtgagtataaagctgagacaaatgaccttgaaaactatatatgaataagggctaaagtgtcagtccaggctgtagttgcttgagaaggacaagaaaataaggcagccatcagagcagtgaggacatattgaaaaaggagaggcatatgctagaacttggaggaggatagggatgtagtaggtcatctctgagcccctacataagtcctgaagtctctatttgatgcttagaatgaccattaccctgaaatcttacaattagcctcttagtttcttcctagggaacatttaatgattactggctccattaagtgttgcattaagccagaaattcagtgaaaccatattaatcacataaacgtaaaaaccagaattagcctctgagctactttgttcctcagtgtccccattgcatatacttggcaagtccacccaaacctatctctttaatatccatgggatccgtccatttctctccatgttaacttccatgactacatttaatactacctttttgtaggttgaattatttcagcagtttcaattgccatccttgcttccgctgcagtgcattgttcatacaaacagcagctagatcattctaacttgcatctgatctgctaaaatcctttcagtgggtctttagaatctttgtcctttggcaataaggaggaagcagtagaacaagcttgtgtctgttctaaacagtgactatgctgctttgggtaggaatcactggatttatagttggcctatactgaacttttggttctatgtgtctaaggggtactcatcttacatatgaaaaatgatctttccagttgaaaaatgatgttatgtataaacctgtggaaaaacatgagagtgtcctaaactcgggtatcaacaataagcctagtaaaatggtatcaagtttaaaggtctagatggtagatggttatttaatgagaggtaaggatggagtatgatttagatttataggtagacaattgggggtataatgtcgttaaataagatagggaaaagaatatgctgaactttgctaagagggaaaattaataaatttaatttgaacatattgtgtctgggatatctctacctccagatagaggggcttggttgtaggctattgttgcaaactatatggagctggtgagagggatccaagctggaggcagatttggaagagatcaggacattggtgatgtgagaaggaacagatgggaatgggtggaaatctaagcacggccaagtaagaaagaagtggactggagatagagctgccatctattgtccacactgtgcattcacctcctactatgaccctagtgcttctgcctatgtcctcccttaggatattttcagcaccgcaacaagagcaaaccttttaacatagaagttaggtcacctcactcccctgtctgaaacctgccaagggctccctgttacactcaggtcaaaagtcaacatactttcaaggttccgcaggccctccatgacctgccagccccttccccatgggctttctggtctcttattttaaactctcctggccccttcattccatggtcccttcgttccattcccaagtgttatctggcttacttatctgccaatataccggggagcctcttgccttagcccttctcagtggcaaggctattctctctaaaatattattttcccagaaagtaccatgtctttctctctttcctctctcagatctgtgcttaaaggttgaccatgcatcaagtgttggttgaccatattttagtaactcaattctctaaccaccaaaaatgggactttttagttctatgttctgctttatcttactccatagctgatattattaatatttttatcctgcatatttcattatttatttgcgcattgtctctcccaatcaaagtgttagcttaatgagggtaaggattgtgtctcttctgttcactgctgtgttcatgacaccccaaacactgcctggcacataacataggagccgctcagtgaatgattgctgaaggactgaatcaagatggggatgaatgaaatccgaagagatccagtgtcttaagtcataggcagcagagagagggttcatttgaatgctatgggtgagataagcatatgtcaagaaatatcttggcaggagttgacataactctgattgctttctctaaaaaaattagggttttttttgtttgtttttttgtgttttattagcaatctaaaagtctctagagtgagcttgccaggttctggagtcctgttcctcatgtactaacacacactgatgtgtgaatggtaggcttgtgtgaacctgttcaggtcagcagtatccttcccttgctctgatcattttagactcaataaaaaaatcagtttagcagcacaacttcccaggttttcttggtgtttgtgttttccctcagatacattgtaaaaggctttattgcaggggcaaagtactttccttcttctcataccttccagtgctaagcacctaaataaagagcaattgaaattttattaattaaatattaattgcatttttctgatatttcaatgaaaacttctaagaaaaggtgattatatttctatattttggcaagaacactggaaccgaagtcaggaaatataaactggagtctcctgtcacctactttttaagtgagtgactttcgaagagttacaaatttctttgtgcctcagtttcctcctatattaattgtaataattatcagtcctgccttaaatcacactagtatggaatttaacaaggtaatttaaaaattattttctataacataaaactttatgaatttcatttatataactgtctgtggagaaactacttttccctaggatttctttgtagatcctctgaatcagacaattctaggtcttagtatgtgaaatgcacatattttagatagtcgacttatttaaaatgttattctgtttctggatttgcattcttttgccttccaatttgatttgtctgatatgttgtgaagagtatatgactaaatgattataaggtatttctggagttattaaacggtgcttcttgtctcaatggaaataacagtttcattttgtagcttatccattttgactagaagaaagcccagaagtgaatcagggtgtgtctatattttgtacctcctaattgattttcaaaatgatataagtgaaacagaagcgaagggaagattgaaatttacaagctgtgtaaatatttccccatagaaataagcttatgaactttagaagagggtgagggagagatgcattttagaggcatgaccaaaatgaatactgaaagatcagacccacatggactgaatcattagcttggagatctcaggaaaatctggtgagtagaatcttctgagagaaggaactttggtagtagaaagtagggtgtaaatccactgatttcaagaagatgtaagagttttacctccacttggtaaggcatgtatatctgaagtcagtttctgtctgctatggactgacttgaggattgactactcaatcaacatatatctataaaatatcatgcactaggcaaattgtgggcactgtggtgaagaaagcttatgacagtagatctcacggggccctcaatctatttagaaaggtagtttccaggccaataatttaaatagtttttgagtgtagggcagaacactgtgggatactacaactttggccagtaaggacacctaacctggtttggaagctcaggaaagattatatcaaacccagtactaaacatttaatatcccaaattccagggtttacacaacctcatacacagtcatactacttatgagaccagtgctttcatttgcatgcagtcaagctatggaatgttgttcagtcactacacttcatgcttttgaactaatgtagtggggtgtactttaaaggaggcagacggcctggacaacagctgtgtataaggtaatctttgaatgtcatctgttaaatggaaaaaaaatgccactcttacttctcagtttgctctgaatatgcactgaaatactgcctgtagaagatgaaccaaagctgacacttattaatgttaggtctgattttctgagccattgattgtgacattatagtaagctcttgtctgtggatttggtttgtggtcttgattcaccttgcagaagggacgggtttctataactctgtgcccttcatgaatgatcagtcagatgccttctaatggggcactcattgagtactgtcttgtgtttgcagcctgaatgttcttgtgttgggaagagccataccagaatctttcagataaagcaatgggacacattgtcatgtatcacactgttatcaacacatctataagtggcccttttcctcagcatagcattttttttcctgggtattatggatgagtttcccatgctgtggtgtagccaaagttgtcctattaaggaaagtcacagcactttggatggtaaggcatgataatgcaattctgaaggggattcttaatgtacggatgatcaaaaggtgaccctaagggcaaattgataattgtgggaagcccagtgcttcccaccagtgtacagagataggttaatttatatttccccacaggtgtttgtctgatagactaatgatgttaagcagaataacaaaatctgcatttaaatgaatgtattataatgtggaaaagtaagcccaaatacaaagtaagcgccatcacgtttgggataaaaacaaagtacagtatcattagagtcctctgggaaaacgtttgtctgtgatttatggtcttattttggagcggctcttatagaccctcctggaacccagctaatgaataaatgataattctacccctctatacatcacacttttttttacttttttttttgttactacagcataaacacacattcccattagattaatgtttctaataaattaggaaaaatgctaagtaagaaagaaagggaaccaaaatggaaaattcagtgaagtacagactctatgggccaagagataatttacttttattagttttttctttaagaccatagtgaaagtaatgatctagctatttttattttaaatattgcacagataattttggaatcgaaagtggaaccaattatttaaagtcctaccctcgtcttccctgagacttaaatagaaacagtagggaaatgcaaagtatttaactggtatgaaactgagagcaactaatcagaaagaatgtcaggcataatacaagagtagaaagaatcctagctgttcactgatgtgccatgtgttaactctttagtctttgaatagcgggaagatctgaggacctagagaaagggccagagtagccacaggggtggtcatgtggcatccagagaacctgtagctatttaccaactgattgagaagtatttcagtgttttaacaactggtatcactgtacatgccagtggactgtgagccctgaagagatagaccattgagttctattttcttgtcaaattgggccacaggaagtctcaggctcattgagatctagttagggctctgtcactcactagctgttgacgtttgtgtaagtcagtgcacaatcaccccagtccctttctccccctttgcagtgatatggagctactactacctacttggtaaggctggtagatgcatatgactagataattgcatgggatactgcaatgcaaagtctgaagcatgatacctgtctaactgtggagaacccctgattttgctttgtccgggattctttttccaacctcactttgaagaacccctgaaggcactgaacatctagatatcctacatcctgtggccaaggggcaggcagaaaacctaagctcatgcaaatttatactatctcctaacaattgtatttttaagaagagtgctacaaggatttttaatggttaaaatttatttatcttgagacaagtgccattaagagactgtgcaagggccaggcgcgtggctcacgcctgtaatcccagcactttgggaggccgaggcaggcggaccacaatgtcaggagactgagaccatcctggctaacacggaaaaaccccttctctactaaaaatgcaaaaaaactagcgaggcatggtggcacgtgcctgtaaccccagctactcgggagactgaggcaagagaatcacttgaacgtgggaggcagaggttgcagtgagtcgagattgcgccactgcactccagcctaagccatagagcgagactctgtctcaaacaaagaacaacaacaaaacaagagactttgcgaggaatgttgcaagctgtcccagtgctgccttgatgcctcttcagacaaggtactccaacttttcctttgattccttataagtaatttcttccaacaagttactcttttgcttaaatctgacacatcaagttttgttgcctgcagtcacagaaactttttgtagagaagtggccccttagttttcaaagaaacacaaatgccactgcttggggctttcctctatctgcttggaatttcttcttccttccctctctcccttcctccttttcctctcttactccctcttttcctgcctacctacctttcctctttctgtctcctgtctttctgttttcaattgtgatatgtagaatcaattctgcatcttctaaataaatcagctgtggagcaggcttccagtttcatggaatttacatgtttgaggaacagatttgagaaagcagtctaacaattttttatgcattacactataaaccaggaaatgtatccagaatgaactagttactcacataaattaattcttaggtaaagctcacatgctatggaatggtttacctgactgaatgatgtctattcctaaggaagtaattttcctgattgtagctgtgatcacgtctcagggttttcacacagcatctcaggtggttctgtctcctgaccaatttcactgcctttgtgtgattatcagtgaagttacacagcagtacaggtaagatatgctgtaaggactgctgttcatgtcaaaatgtaatcgtgaggtgaaaattgtgttcagaacaatgctgtcccaggcctattaaggacaaaggagaatgaaagagcaatgtgctgtcataaaaccttgtataatgatttcaagccatgctgggccctgacagctgagggaggaacaggaattgagttgggaccatgcttcctaaacttatgcagctaatttagtagtagggatgttgtctctcccatgatgggttcgcagtgtaaagctccatgcctgagggagttggtacaatgtgggcatgggttgatttctagcagtacaataaagagagagaagtgaggtgagaagaggaagcttatgggcatgttaggccctgcctgggaggttttggaaataaaaaaataaaaacttcattctgagaaggaaaagagtaatacaagccttggtgcaggctttgcctccaagcctgaagggaacaggtgtgaaaaacctatatccagtccactagaatagccctgcaatgaagacacaaagcctgtagctggagtgtgtctgtggatgccacatctgactctgctaaacacagcagacccaagggtgggaggccactgaccatcctatctcagtgtctgacctggcagttttgagcctctgggtggctactgggacaggctggagaaggtagtgacctcaggtgcagtatttgggactaggtttctgaaagctacttgtgtattctagaaacatgcctgtttctcctctgtgcagaaaatagcccctaaggaaggggaacatatacatagagaagtagtgactgtttgaattaatcaatttatttattatttgtctgtttctctgctgactgcagacagaaaaaataaaatacagtggaagatcagataagggcaactcacactgtgacaaaggattttactatggaaaacattgtcaaatcatggtaccttgcctatccaatagcatttctctaataaaatattttctcaagaaggttattttgcaccaattaaacataaggctttgtcattaaatgttccaaagtttaaattgagttcctgtgggttgtatgtgcatttagtagtctgactgctttcccacaagaaatcaatatttctctaagatttgtgggaatatactattcattccaatagagacgattaaaatgttaacatgtaacaaactgcaaatctggcatggaatgcattgttttcatacatgcgtttagaacagaaactcagattggccattgtttatggggagttagagtatatcagacatgacaaatgtgttattctccccagataaatgtattttagcctgttgacaccaaaatgctcagggacctcaagttaagactgaaggtgaaaaagaaatacaatggtggaagttaaaacatcaccatcctaaaaacaactgtagtaaaattaaaattctgaaaataggcaacagcaatgaaaacaccaaaaatccagagacaatcaatatccaaaataataactacaaaccattgaaagcaaatcctcaaaagtatgtttgaggttcatggaaaagactactttttagactccacaaaggttggtggacttgaagttgtgcacagatctgcatttagtgttgtttgccacttcttccttaaattttctgctgacttgaattcaaagcatagactttatcgttcagactggtttttgtttttctagatcaactgttgaaccaagtgggatgctggaacgataagcataaactggaactcttccaggcaaatcagtataatagtcaccctaatgatgacccattcctgggtccttctctcatgaccattccttgtcagtctccctgcctgtgaatttcactttcgtccacacttcaaatgtagagtttatcaggggttccatttttcttcatctttgggagtgacagagttttcctagtgatcttatacacttacaacttaactccctaccttgtttctcatgacattcaaagacataactttatctcttaatctatagacccacatgtttactaattactatcacagagttttccataaatagctccaggtgaacattcctaaacccaaactcattctccatatcccccaaactcccctccctcctctgtcttctgtcttggttttcaccgtctaactagttttcttctccttgccatacttctactctgcaatcaatgacaacagaaacagacttttcttattttattttaagttcaggggtacatgttcaggtttgttatgtaggtagactcatgttgtaggggtttgttatacagattgttttgttacccaggtgtgaaaagtgttgacttagagcatattttgagaaaattattatgcaaaaagtatctaggtctacattttctgatgtgagttacattacaagagaacctcttcagtaaccacagcttgctataatttcatgttagaaaaagcaccatattacaaggataagacatgggcacaagccagtcagaatgcatgcctcaacaaatcaccataaagcctggccctaaacaatcagtaagcacttatgatgtataacagctaaatatcatttttgaaattaagtaagactcatggctcagaaggggaactaggggagtggcaagactccaggacaccactgtgttcccccactaactggttcttccatttttgtcactgatttacatgtgataaaatacacataggattattgaattcctgactgcataattacgactggtattttcaaagccaacagaataaaagtgttcaacctgacctataggatccattatggtcaacctcctgtcacctttcttagctcatatgctgacactctccacaacctctgtccctaccattctgtactgtgcatttgcttttcctccaacagaagaaaatgggccccatttttccggggcctttctactcctgttttctcgcagacaaggttacttctccctgcacttccctccctgtgctgcttaccaactacccctgaccaagtatcccctttgtgatctagtggattctaactcatccttcaagtctcagctcaaatataccattttcagtgaaatatttatttataccaaactcctccatacctctagaagattaatcatttgcttcccttggtctctgtacatccctctctgctagccctcaacataccacattccaatgatatctatttcacacactatccccagagactgagcttccagaggcagatactaatcttatcattgtttccatcgtgcatctagttaggtctcaatgggtatttgttagataaatttcaaattcccacaagtgtgatgctgacaggtcataagcgcaggccccttccatggaagaagggctctgctggtgaaacatggaccatccctgtgcagacattcagcagaaagtctatgcacactctttcttattttgatggtttcagtccaggtcttgccaggcaacagatgatattcccagatggtacttttggagagactttcccatagggattatttacccaagtatggatagagttaaaagaaccatcaagaaatgctactccattagaacggaaggaacaaggggcagaatggttatacccaaggtccagttgagaataggagtcatgaaagagagatataagatgaagtaggctaaggatattgagttctcttcccttttatctccgtatccttgatcctttcttttttctttctgctacttccctttcaccatttgccaccagaagctgccagagggcaaggaaatccaggcaatgcatcccattgagatcggctccttgggtacagagcagggtggaaaagaacagaaaataaataaagggtaaagacaggacagggacctaaacaggattgttcaatcttgaatgcctggcacttccaagaggcccaggacacatagaaaagaaatatttattacatgagtgaatggatataagtaggagcaagtctcctgaccctcacttattccaaagactttttcatttcaacatttctgcatgttagcctgttgcaaaaccacaaatctgctgccaaaaggtaaggctggatgtttggttctcttatgaacaggagaagactggcctataactgtggacacaagggaaagcattttctgacattcagatcatttggaagcatataaaagttaaatctgttctacattgtgttggaaagaaagaaaaaataaacaaacaaacaagcacaacaacaacaaatcacagagaggaaggaaaaaaaagaaaactgatgtgctgtgtccccaatttgtgcacgattctctgcagtggttcaagtttatcccagcttatcacttaaaatcaatgacctattttcttacccttgcctacgtattctctgtatgatgcactttgaaaagtgttgctcctcacacaaacaatatcaaaagccacctgggtgagttgtcactccttgttactcatccccgctgggcaccttcgggaaatgagggtgaatttgaggaggattcagagctggtgaacaagtcccacagagatgtggtggggaagagtggcaccagatagcacagaagctggccattttatttctcatcaaaagagcaggaaataatatagtcaataagaagcaggaaggagccaggggattttgtgaataaacaccagagtcactggaagaaaggacagaacaaatccttcacgtagccttggatgtccttgttctgccctgtagtgaacaagggaaaggggaagagtgtgatgaatagatcatgtcaggaaactatcagacacctcagcttctctcgtgtctactttatctcccagtttagagaaaaaaaaaaaagatttccttcaacttttcattgtaagctattgtttgggcttataacaggcatattcaaattgcagatggaaatgatttcagaaactgtattgttctttttgttatttattgtttcatttttaagaccagaaaaagcacacctcttagagagtgtgcctatattctccaatgaatatcgaagataattttctggtatattttctgataaataaaacaatataataaggtagttgctgatatgtgcatgcaaagctgaagtttattgttcttacttttctacattttgagcttattataaaatctatgaaactttcaaatatgtgtaaatatataaaatatacatatatagactatatatataatgaatatacatatacacattccatacacgtataatttatttttatttatcttttatttttttttattttttgagatggagtttcactctgttgcccaggctggagtgcagtggtgtgatcttggctcattgcaacctctgcctcctgggttcaagtgattctcctacctcagcctcccaagtagctgagattataggcatatgccaccacgcttggctaatttttgtatttttagtagagatggggtctcaccatgttggccaaactggtcttgaactcctggccttggcctcccaaagtgctggaattacaggtatgggccaccgcgccctgccatacatgtatattttaaaggttaataacaaaaccccaacctgcccaaggcctacttaaagtacgctctcagtaagtttcagcacttttatgtcactccttcattgcatgctattctgatctccgccagagtgaattttcggtagatttttttccttgcttctctttttagctttatcatatatgtaagtataagaaacatttaattttatagttttgtgtttttttgactcctatataaatgaaactgtagtatattcctttgtaaacttgtccttttagttcaatatcatttttttaaaattcattcacaaagataccaataattgtatttcttcattatcactattttataatattccactgcatgggtatgccacatattttttcctttttattttaatttctgggatacatgtgcaggacgtgcaggtttgttacataggtaaatgtgtgccatggtggtttgctgcacctatcaaccggtcacctagatgttaagcccagcatgcattagctatctatcctgatgctctccctcctcccacaaccctcgacatgccccagtgtgtgttgttcccctccctatgtccatatgttctcattgttcagctctcacttgtaagtgagaacatgcagtatttgattttctgtttctgcattagtttgctgaggataatggcttccagctccaaccacatccctgcaaaggacatgacttcattcctttttatggctgcatagtatttcaaggtgtacatgtaccacattttctttatccaatctatcattgatgggcatttaggttgactccatgtctttgctattgtgaataatgctgcactgaatatatgcgtgcatgtatctgtataacagaataatttatattcctatgggtttatacaataataggattcctgggtcaaatgttatttctgctctttaaggagtctccacactgtctttccaatggttgaactgacttacattcccatcaagagcgtaaaaagcattttattttcctggccaacatggcgaaaccctgtttctataaaaacacaaaaattagctgggtgtggtggcacacacctgtagtcccagctaattgggagactgaagcaggagaatcacttgaacccagaaggtggaggttgcagtgggccgaaattgagccactgcactccagcctgggcaatagaatgagactctgtctcaaaacaaaaaagtaaaataaaataaaaatagttttcctatttctccacagccttgccagcatctgtggtttcttgactttttaataatcatcattctgactggcatgagatgagatggcatctcattgtggttttgatttgaatttccctaatcatcaataatgttgacctttttttcatatgtttgttggccgcatgtctgtcttcttttgagaagtgtctgttcatgtcctttgcccactttttaaatgaggttgtttgttttttcctgtaatttgtttaagttccttgtagattctggatattagacctttgttaaatggacagatggcaaaattatttttcccattctgtaggttgtctcttcactctgataataatttcttttgctgtgcagaatctctttagtttaacaggctccatttgtaaatttttgcccttgttgcaattgcttttgacatttctgtcatgaagtctttgcccatctatgtcttgaatggtattgcctagattttcttctagggtttttgtagttttgagttttaaatgtaagcctttaatccatcttcagttaatttttgtatgaggtgtgaggaagatgtccagtttcaattttctgcatgtggctagccagttctcctagcaccaattataaatagggactattttccctattgcttgttttcatcaggtttgtcaaagatcaaatcgttgtagatgtgcggtcttgtgtctgagatttatattctgttccattggtctatctgtctgtttctgtaccagtactatgctggttttttttgtttgttgtttgtttgtttttgtttttgtttttacagtagccttgtatagcttgaagttgggtagtttgatacctccagttttattctttttgctgaggcataccttggctataagggctctttttcgtttccatatgaattttaaagtagttttttctaattatgtgaagaacttcaatggtagtttaatgggaatagcattatatctataaattactttgggtagtatggccattttcacaaggatatggcacaaattgttgatatattctagtggatacttgtgttgtttccagttttgttattgtttttctttttgccgtgttaaatgagaccactagaatataaccactggatcacagaatgttcatctatgtcttcctaaggtaatgccaagttgttttccaaagataataatacaagcttccactctagctgccagggtgtgagggcctctgctgctccacatatgctaatatgaggcagcacatgggattgtcagactccctgatttttgctagtctgttggagatttagtggtatctcaatgtgattttatttatatttacttgaaaactatatgatgtaagtttccagttgtgtctaatttcaaaagaaaaaaacaaacaatgtaacagaacaaaacaaaagcaaacaatataacaaccaaatggcaacaacaacacgcacaaaataaacacccaaggaaccttatttaaattatcattcttgagccaatgagtaatttactgtttttgttttaatgtatgctctatcttcatctgttaggagattacctcactatacagacagattctccatacagatcaacctaacagtaagaaatgtgtgtgtttggcacagtgccttgggaagaagagctgctatgtgtcattgatgactctattgtttcaccagttttcctttagttactatacaaatgggaacaaggatgggaattagggaaattttccaagtgtaagaagctttcagatcttctcacatcacttattggatatgcagtgacacattagacctttattttgtataaaagttgtctgttccttctcttgcttctccttcttccaaattgttgacctgcatacaacatcaataacaaacccattaaacaatttttaagccaatttagtagccaccacttccaggtcactaccaccataccattttgaaagtggctccacacagggcttcttctggaagtttatagtatccccattcagggccaactgtgcaccttctgcagaatgagatggggttccccaacttttgtgtatgttttttaatcctctcttattctgggatgttaggccctgaaaggacacaggaacagggctgatcatgcgtgctttcagggcccaaacatccaagacagtttgtaccaggataaccccaatagttgttaaaatattgaagcattcccatgcaggttggtcaataagcaattgtctcagaacttgtatggccaatcacaatgggaagcctctaagactcttttgtagcagcatagattggtgtctattttgaatggttggaacattgtgtgtgtgtgtgtgtgtatgtgtgtgtatgtgcatgcacctgagttagtggaagtaaagtaaggggaagagaggaggcaatgaggtttgtctatgacattctcactctcccaggttgcttcttttctttacaaaatccagagcagaccactttcaattttgctttacttccctttccatctatctaggacttactgcagcagacctccaggttttgtatctttactttctcccaagatcagcctcatgaccagactttgatggttggtggagtaataaggggagtccaatcaaccaatatactaagtataaggaactgaactgggagccatttcaaaaatgtatctatcatccacacacacacaaataatgcataatgaccttttgggtagattttaatgaaggaaaatgtaaatcctcaatgcaggttgcaaaaaatgaggatgtcaaagtaacccataataatgcctcttgtattattcatggtctttgatgaaagattttttaataaacaatttcacctttatcaaccaaatttaattacatttgtaccaggataattctttacttgtttggcttagaaatgacaaagcttctttccagattcattatgtatttttaggatttttcaagaaatcaggaagtaagagttattttcaaatgcttttacaagggtgaccaagaggccagtgttactggaaaggaaaaatatatgatgtcaaactcaacccactgaatgccaaaaataagaaggtattcattactgaacccagttttattggcagggaaaaatgcaattgaaaataccaatcaccagtaaagcatatatgaaacaatgctctttcgtagtcattttgcatttaacaagtttttaatttttttaaaaaaatgggaatacataagatgcttcctatgcaaataaatttcatgaatttcagtgaaaatactttgttttcatcccaggttcaccacactctttctatctgacagatttttttttcaacagaatatgggagtgattttgtccagttattcttctaggtctccgtggaaatttctttcttttatagataccatctggcctaatgagattctaacagttctatacacactctgtctttctttgtatttgcattttttcactggagtcattgctggtagtgaaatggaaaaataaggggaaaaaagtatgtatgttaaataagcatggcagttttctctgtcatttaagaaaagtaattacaattattcgtttgatttactgaatgtaagtattcagtttgaacactgtccaaaggatgttgccttacttaaatatccagtgatcctaaactaaaattgcggctgtagtcactgatgggtttagtctaggaatatataatcttgtgtgtcttcaaaatgttaggaagaaatcttcttaagcaggatttcattatgtgttttcaatcactaatcttcactccttgtctctctctctctctcaccccgcccccccgtgtgtgtttgtgtgtgtgtgtgtgtgtgtgtgcatgtgtgtgtgtgtgtgtgtgtgtgtctgtatgtttctgtctgtagaattaggtggagggttggtaagaataaatacaatcctacactgagatgtagaggtagcaagccaaatttgaggtaattatgctaggactcacattgttagcttccttgttcaccaaatgtacaaatttagctcataatcaatatttttaatgcaaaagtttatataaggtccatactgggtaaggaaaagaaaaaataacattaaacagggacttacatcctgacaacttttgtctcatgcatcagggactctgtcctatgggatagatctacgcgtatttggggaaacacattggccagtggtccaaagtggagggtagctctgggataagaaaggctttagattcatttttcaactcttacatttactgttgacataggacatgtttcttaaactttactagcctgtaaaatcagtggagtagacaagaggagataaagtacctaaaagtgtacctagcacataggaaacaataaaaattatccaattgtgttttaagaacctattttgactatacagctatgtactttgaagtcaaagttgtttacatgtgagaaaggaaatggaccaacagaataattatagatggcaacatcctttgcctaatgaatcatttgttaaaatacattcatctaccatgtgtcagaggctggtgctgaggctatgtaagttaccaaaggaggcgaaatccatgctaccgtggagctttcaatctaacaattaatgataagcagatcacaacatggcagaatagtagatacattagaaaaaagtgtctgctcccccctacacacatattagtcatttgtaaatgtttagaatgataaacattaaaagttacattttctttaaaaatattttatttggccttacacatggaagtaattttctctggctaggcttgtatttttattatgatatgtgaagcagttaacataactcatattaacactggctggaggttttatcttcaagggcagctggtgacagggccattaaggtccacagagagaggtggaaggaagggtggtctgaatgggcaatttctcatttgttggattgatccttgattttatcagcatgctcacgttcaaaaaatcccattgtgaggtataatagatgacacctgatactaaaaatctacctaccagcctgaacagttcagaaattaatgcctctcataacaccaagagatttgataatgaagccagctcagtagaggtcaaggggaaatgatattatgtgtgttcccctatgaatcaatgtaatcctattgcatttccccagatgttcacccctggcctgtgcagctacaatgtgatctcaaagactttcataggaatcctactaaacaattttgtctaaacttgaggcactgaaaaactgtgtatggtgtaacaggtggagtttacatggcaggttcctttgtccctggagatctgatcaaatggatcctcatcccatgctccttgattgtccggagtacttccaagtgttcagagagttcttaggagaatctatagtctcatggtcacttttggttctactttatcctctaaatttgagttaccttgccattctgtgaaaggtttctctgttcttcattgccttgacccagatgtgaaatttcatcacctgctcaatttccacacctcccaaccaaccttaaaagtcatttgaatatagcagattgttctgaaaatttagcaatgtaggcgttatggggtggaggtaagggcagagccttatgtgatgacaacacaaacaccatcacatttatttaaaccatgactttctttaaattccctttccctttccttcataggaacactccaccagcagcttcttcagtttatgtcctcagtacccagcctggtcccatctctcttctgggctctgttttgtgtattcaagcatatcagtatgctttgaagaacaaaaggaccttgcttaacacaatcctcctgctcagaagaaatatgtggttttaaataattttgttattattttaacatggcaaaaattcttgggcatgctggagtgtcaggtccatgggggagaaagatgagttgaagctggacaggtaagacgcaaccaaactggggaagaattagtggcttggtgaagtctttgaagtttatacagttgaaaacatgtagtcaatgaagaagtttaagggcagtgaaaccatgattaaagctttgtttttgaaagtgactataaatgagacttgtagggaggcaacagaaattttggaagaaaaatgtttagggctttgcctgaactaaaatagtagtagtttaaatgaatatgatgggatgtgtgctatggtagatcatttttcctgtgctatgggggtaagtgttagcttctttctcctggactagtgtgttagattcttgagaagatggattgtctaattcacttacaaatttcccagaagctgtcctagggcttccatctagtatgagccctgtaaatgttatttcagtgtatggaataagatgattttctgtccacatccattaagggcagctttagtcaaaattaatacatggatatggttgttaaaaaggatttttccacattgaaatttaaatggatccaaatcttctagtctcctggggcttcactttttacccagtaagatgatgggagtcactatccctggaaatagaaggttctagctgctctactcacacacatacacacaaaaccctcagtaatcatttttacctggtattttcgtaggagggtaaaaagatgacatttttaaagctcttttctctcatctcaaccagcttctctcatctcagcttgtctgtctgtataacttgcccctggactgtggttctgagctcagcctcaggcctattggattggccagtctccaaaatcaaattctgtagcacattgtcccatagttttactgggtaaaggaagatgaagacaatgcaggaagagaacaactgactgtcgaacattattcttctcaaaatatattggtcattcccactctaggggaaaatttaaagtactttgggttacaatgaaatatcagtagcctctttttcccctaattaattctttccctgtcctttctggattctgaaaatccactggtgttcgggtataaactccgaaattgtttgtcttgcttatgagggcattctaattctctgtctaaacccctcttatctattttctacaggattgccagttaaaatacaagactccctgttaaaatttaatttcagataaaaaataatttttaagcataaggctgcagcatgggatatactcaatacaggtacacctcaaaagtattgcaagttcagttccagaccaccataataaatcaaatactgcaattaaagaaagtcacactcttttgatttatcagcacatataaaagttatatttatactatactgtcgtttattaaatgtgcaataacgttatgtgtacaaaaaataccttaattaaaacattttatttactaaaaatactaacaatcatctgagctttcagggagtcctaatctctttgctggtggaaggtcttgcctcgatgttgatggctggtgattcatcagggtggtggttgctgaaagttggggtgattacggacttttttttattttgagacagtctcgcactgtcgcccaggctgcagtgcagtggtgtgatctcggctcactgcaagccctgtctcccgggttcacgccattctcctgcctcagtctcccgagtagctgggaccacacgcgcccgccaccacgccctgctatttttttgtatttttagtagagaaggggtttcaccgtgttagccaggatggtctcaatctcctgacctcgtgatccgcccgccttggcctcccaaagtgctgggattacaggcatggccaccgtgcccggccagactgtggaaaatttttaagacaacaatgaaggtcgctacattgactgactcctcctttcgtgaaagatttctctgtagcatgtgacgccctttcgtaccatttttacccacaatagaacttctttaaaaattggggtcaatcctctcaaacccagcagctgctttatcaactaagtttatggaatatcctaaattctttgttgtcacttcaacaatggtcacagagtcttcaccagatgaagaaaccactttctttgttcatccataaaatgcaactcctcatctgttcaagttttatcaatgggattgcagacattcagtctcatcttcaggctctacccctaactctagttttgttgcagtttccaccatatctgcagttacttttccgctgaagtcttttttttttttttttttttttgagacagagtctctctctttagcccaggctggagtgcggtggtgcaatctctgctcactgcaacctccacccaccgggttcaagtgattctcctgcctcagcctcccaagtagctgggattacaggtgcccgccaccacacccagctgatttttgtatttttagtagagaaggggatttcaccatgttggccaggctggtcttgggctcctgacctcaggtgatccgcctgccccagcctctgaaagtgctgggattacaggcatgagccactgcgcctggcctccactgaagtcttgaggccctgactatcattgataagcgttagaatcaacttgcaccacaatatgtattgttttccaccttctaagtacgtggtttgtggtaccccaaaacaaccacaataataacatcaaaaatcgctgatcacagatcaccataacaggtataattttaattttaaaagttcgaaatatttcgagaaacaccaaaaggtgacatggaaaaaggaagtgtgcatatgttgtttgcaaaatggccacagtacacgtgctcaatacttggttgccacaaaccgtcaatttgtaaaaaatgcaatatctgcaaagtgaagtgcaatgaaaagaggtatgcctgtttactaaaaaaaaaaaaaagtcattgtttatctgaaattcaatttaacatggtttcctttatttctaatagctttattgagatataattcctgtcgtacaatttagcaatttgaaatgtacaatttaatagtttttagtaaaaacaaattcatatctccatggctacagtagacatttttgctactcagaaagacccctgtaggcctttgctattacctctcaatgccccatcccctgtcatccccagacataataaaacacaaatgtactttctctataaatgtgcatattttggacatgtcatataaatagaatcatgaactgtgtacacctttgtgacttgcttctttctcttagcatgaagtttcaaggttaatttctgttatagcatgtatcagtactttattatggagcaatattgcattgtatggatctactatatattatttatcatttcatcacttgatggacatttgagttatttcacattttggctattatgaataatgctgctatgagcatttgtatacaagagtttgtgcaaacatatgcttttatttctcttgggtatatatctaggagtagaattactgtactatatggtaactttaggtttagtagtttgaggaactgccaagttgttttccaaagtggctgcaccatttactttcccaccagcagtacttgagggttccaatttctctacatcttttctaataattgtcattgtttcttttttgattatggttttgatttgtatttctctgataggtaatgatggtaagcatattttaatgtccttaccggccaattttatatcttctttgggtgaatatcgattcatatccctcactctttttttaattgggttatttgccttttttcattattgaactgcaatggttatttatatatactatgtacaagttacctctcagacctatgacttgcaaaagtttctcccattctgtgggtagcattctgcacttttatttgccaaattgtatttgcttaattctataccaaaggacactcaccttacataactcaaaagtctccataaggtattttccaaacaaagaaggacttctctcactgaaaggaattttgctttcctcctggactttttggctccaagtgtggttgacttttaaaataagtttatttattttcctgattgaatttctctgtgttctcattagtcatccgattttcagcccttttctgttgaacccttttcatcaaaaacaggtactgagaaagaagatcttgttttcccttaaagttttcccttaaagttgttactgagttaaaatgtagagcctgaattgtgaagtggatgataagtggtcttcacaattaccctggaacatctccttgtacatatctaacaaacacactcttttctcgtaagaaccaaaacaagaggcacctttgtgattatctattcaagacaccttataaaatatatctcatttgtatcatctccaatagtaacccacgagccatctaatagcaatttcagaatgaataaaacaaaaaatagcaatatggttgtgacctgctttaaagatagtagtgtacttatattacaggaaaacaattgaatgggactacttaaagggtaatttatgtaaaaatatataccattatatgagatacatagtaggtgctgaataacgttagtttcataattgttttccttattcagtatttaaatttaaacccctaaaaataattcactggggtatcaaattatatgcctacatttgtaaactggaatcattcagtaactgcaaaatattaagtatctataaaaaggcctaggcattgtattagagacttaactcataatttttcatttatttaccataattctctgttagatatatataatcacttttaggttacatatatattcactgagttccagtaacatattcaaattcatataagtggtaatataaaatctgctcttcaaatatagagcagtctttcctgaaaactcatgttctttttaatatagaacatttcatttcaaatcctatatattttacaaatgtttctttttccagagatcttctctgatcactctgagtggaagtaatttgttctataatggacctccagagtaatttcactgggaccctcctatggtacttagcattttctacatttttatatttattggtttctcagtgttttcgctgtaattttatttcttctcccatcatctctccttctatattcacagtgatagatctttcactacaatgtgtttactaatatgttagaaagagccaataagtgatatgcagcagtgatccccaacctattcttatcatgacaaacatagacaattaaggcactgaaattctacttagattaaaggtggattagcttatctcgatcaataacaaaaaggatgggcttgaaaatttctaaaaagcataacaaatctaaaaagtttgtaaggaattatcattacaaaactgatgagagagagaggtacctaaaaaagtaagtagagcatagaagatgcttttactctggatagaagatgcttttactctggaaaaaaaaatccatctagccaaattttaactttgtttttctaactgcctaaaatgtgtgagaggtcaaactccagaacacatccaaaacttgagagtttaacaggaaatcctcctaacgttgagggggtatcccaaatgaataatcctggagaagagatttttaaaaatcagctttcgtattcatttcaaacccatattgacatcaattagaagttcacaaactatgaatttatgataacttttgagcagaccagagggactcctaggaaccttaaaacaaaaagaaacagtttgtaaagttgtatctttatcttaagcccaaaattattgctgcagattttttttctagggtgaggaacatcatgcaataatgataaagcatatcaaatataatcaaacctacagaaaatgaggtaaaatgagttagaaaccagaaaaaaacagacagcaagaaatagaactagaaagaatttcatatatgggaattatcagagacagatcataaaacagccatgattactacttttatgaaataaaaggtgaattgagaacatattccaaaaacagaaacctataaaaagtggcagatcaaattaaaaacttacaaaatacaacttgtagaaatcaagaatacaataactgataaataactaaatggatgaattaaatggcagattagatgtaactaaagagacagccaggaagaaagatcagggaaattatctggaaataagattgcagagaagaaaggataaaactatgcagtaaatttagttgactgggtggacacagtctaagttagcgagctatgaaatggaagcaaagccttctgattccctgttactttctgggtgttagaataaattgctttactttatacttcaatataatttgctataatcactaaaggaatataaataggtaaattaacttcagaaattatgtcacaaaaattgcaggataaaaaatgctgcataccttaaatatacacaataaaatttattttaaaaattaatgaaaatattaataaaaatagaatagtggataaaataataagaaaaattaaaattgaaagtacaaatttgaaaggagaacacagggtggttgaaaaaatgaaatgtatttacaatgaaattaaatgcaaattgattaaatgctctagttaaaaacagattatcagattgaacatgtatattctgtttataagatatatgtgttatttagatgtacctaaagcataaagataatgaaagaataaaaatgaaaatacgtacaaatagtaatcaaaagtacaaataataatcaaaagaaaggtgtagctataaatataacaaaaattgtcttttagccacaaagcattactggtgataaagaggttcattttataatcatgaaggtttgagtcctccaatcctaaatttatattcacctggtaacagttttaagatatataaagtaaaaactgataagaaagaaacaaatattgaccaaaattaaagaaactgagaaaacaaagagtaggaatgagttagaagaattgaacaataaaataccatacataccaaacaactgaaaaacacaaattacttttaggcatatttgtatccattatggaacattcacaaaatttgatcaagtgctaggtgtggtcatgtaaatttatatcaccattttggaaatgttggataatatctattgatagtatgtttgaagttacatactcctttgaaccagcaatctcacatcaagaaaaatactcttgagaatatcatgaaattgtcttttagggcatatattcaggaatgtttcataccaagactatttataatagctacaaactggaaatacccaaaatgctaccaataggagcatggataaaaaaactgtattgtattaccaaaaaaaaaattctatacaacaaatggagaaaatacaacatctacagatgtcaacttgaatgaatcatgccatcaaatcttgagtaaatcaagaaacattccaaatgatgcttaaaatgtaattccatgtatgtaaaattaaaaaaaaaaatattagtaaatataattgtttagaactgtgtacataaatagtaaactacaattttaaaaaatgtgcattacaatggtaaagatagtggctgtttgcacacagagtgggaaggaattatagagggcttctgacatgttggctgtgttctgtttttcagcctggatgatctaaacatgtatattttccacgctgttctctttgtaagttatatttgacaaataagaagatttttaaaaagccaatttgaaactattttagggttcataggtataaaagggagaagtagctttcagccaaaagggagtctccagttttacctgactgccttaagagccttggaggagtcaatgtttatcttctctaacccttccagggaggtcattatgctatctcctactttgtagtccccagatcaaggaaatttaaaatctcactctacttgatcttaatgagctcttttgtttctttacctccctctctccgtctctcctttctgtttacaaaaatgacaggttttatggtccctgtggtagcagttttatacagtcttataacaaattgtctcaacctagatgctattgacatttggactagataatgctttggtgtgtttgtagtgagggctgggggtgggggtggggctggcttatacattgttggatgttttgcagcatctctggtctctacccctagatgtctgtggcacaccctcctttcccccagccttccttcccacttgtgacaacaataatatctcaaaatattgctaaatttcacttaggggacaaaacagcactgggctaggaacaactgacctacagctatgggcaaaaggagtctttaacaactattgttggatcagtaggtatacattcaggcttcacatataggtgcaggtttaagcttggtaagagaggacatgaggaggtatagctaaatatatagaggtacgctatattgaagggaagttacatctgctggctctaaatggtgaaaattgagtggaagttttgatcagatgaatgacaacaggaaatttttaaaaagcccaatcattaaagtgatttgcaaatacattaaggtagggatctcccatcatggttagtattctagcagaagctgcattaattcaggaatattgaagacattatccctggatatttggacaattcagagttctggtttccaaggtctcctctactgtcaggaggatgacctttaaataaaagactcctggacttatcagggacagtgtcttgtaaaaagccagtgtctttctctgctgtctcggagacagagtttgctattaaggatttttcattgcttttttgattgcttgtggccttcaaacagtgttgagtaaaaatacattttcatttttccagcatttctgagccaggcaattgctatttagtttagaaaagaagattggcttttttctattagtgagtgtaaaaaaaaagtattgccagttgcagaaaaaaatccatagaaagactctctctcatcatcatcatgtatatttgactaaatgtttcctcttttttagggggagaccacatgacctggatgacctaggatagccctggttatccttctgcctcgcatcctgtctagtttagcacttgttctaggtttttcacttgtaataaaattgtcattaataaccatgacatttaaataatctggaatgcttttggtagactgcgactttgacttttagcttccaatatagtcttacctaagagcaagatttttaacatgcgcttagaagtcgcacatctttcttttcatgattctttccaaatgcatcatagctaaatctctctttgtaaggtagcaggcagatgtttgctgacataacaaagtcttctcaaatgcgactaaggactgctaactctgtggcttcaggtgtctgtggtagaggcatcgggcttgttgcccccagcaaccacttggtgtaccagccagttctatgacctgtgctaaacctgcctggtgcaggaagatacagtacagcaactgggagaggagttagagtaatacatggggcattactggttaggaatttgtagaatatgtgagggtaataaaagttcaggcttccagttgtagaatgcctagaatagtataaatgctatcactacagtggttgtgttatttattgtatggaataaatctacaactgtttatttagtttgttgtttggcaatgcttatttttaaataaacctttttagcagcagtagctcaaataaacagaagtgcatgcttagagaatttccagtagctaagaaagtcaatgataaacatgtacttgagcaaaatgtttctctacatttagcatcctccatgggaactgtagtgaaatcactgaccacacaaaagccagaagacctaaatctgctaaagaaacaccagcatctacttaaaaaaatcacttgttattttaggaaactgtgcctaaggatgacaaattaatacagctctgaagtgtgactatcaaataatagttcttttaaattaacttcactcattttctattgcaagtattgttatccatatacaaaaaaaaagtcaaactgaagtagttgcaaatgtcttggatttattaacagatatctttgcaaacagttaaatgatgccagttttatatcgatgttatcagatggtttaaagagaaagccagttaaggccaatatgggaatttcttctagttcatggaatcaaactaaaagtttagggagttcattccaacgtaggtaatgcatctcatggtaatttcaacgctacaagaaatttagttataagagttcaaaatgaatattaaagagaaactacttgtttctttttcacagtttaatacacatacaatttttgaatgattcttgtgtcatgataaaggcaatgttcttattaaattatggaagccatggagcagaaatgtagtaacaatagcctgtgtacaaacataattcataactgggtccaaaaagccttcaataatctaccaataaaaagaaaagctatagttgtcaaaatttacaaatatgtttaataaaagaactttgaagaaaaactaatgcttattattaaatatatattttagcctggtggccctcgtttctctctacaaggcttatccttaattgtttttaaaaatgttgagcttttacataaatacttggcaaatcaatgttaagtgttccggaatcatatataactttttttgggaaactcatttctaagcattctcttaccaaactcagttgggaaattttaataaaattatgcattccaaagacatgccttcttgaaggtagagttcccagaaagataagacattaaaaattatccctgcaaaaataaaggaaagactgaatgaattaaacatgaatccaaagtttggacaacattgaattttagaattccattttggcattttagaatatcttgactcactgaaaaattattaaaaaaaagtttttcctggagctttgtttttaatcgaatgagtttatattgtatattagaatgacatcaatttgagaaggcctagagttttgcagtatcctaatttagtgaaatattttaaagaatgataaaaggcaatttatttgttgaattgcatcttgttaaaattattaacaaagaaaggtactgtaaattgaagtaaaaatgtatttatgaaaatatttggactgaaacatttgcatgtttcaatatgaaaagaaaaaagagctgagaatagagtgcacttagaaaaatagattccaaattgttgcaacaattttagtgaaagtattttctcaattaaagacattatggtctatacaataatgtaaatgaagaataaatttaaagtattaaaaatatgaaatttattatacataaaatgcgagtccatacaggtttacaggtaattaaaaataatgccatcttttcaagattccttctcccattaccaatgacataatattagagacagatttaaattaaaagttgattaacatatatgactatctatgaaagatgattagttcgatgatgttattttttacatgttcaaatgacaaaacattttttgttattttgcctttattgctattatataatgagaggagatatatattgtttatatattttagaaataattttacttttaacattgtttttgaatagaaatattttataatctaccaacataagccaatttattaattaataaacagttatttttaaaaatgtgatacattatttttgacaccccatttcattctccaaaatatcccagtttacacattaaatcacgtgttcactcatctgtgataataatgacagagtgttctgtgaatacacacatacacacagaggggcacatgtactctcaacaaataataggattttttaaaataacgtattttcaccttcacctaatcttagtcaacagattctaagtgcttcttttctttaaatttttattttgtaatgttaagaacatttaacatgatacctaccctcttagtatatttctaaatgttgactagtggtacactgttgtacagcagttctctagagcttattcttcttgcttattgattactaatttctcatttcctccttctcctagcccctggaaaccactatttcacaattcaattctataaatttgattattctttttttatgaatatataacatttgttcatatttaaggagtatatgtgatactttgatataaggatacaatgggcaaggatcaaatcactgtaattaggatatccatcgcctgaagcatttatcatttctttgtattaggaacattattctactcttttagttattttgaaatatacaataaattattgttaactaatgttgccctattatgctaccaaacactagctcttgtttcttctatctgactatatgtttgtaaccattttagacacctcatataagtgaaatcatgcagtgtttgtctttctgacttacttcacttagcataaggttcatccaagttatggcatgttgcagatttctttcttaaggttgaatagtaatccattgtactatatatatagtacaatacatatatagtactatacaatggattactatatatctattactatacaatggattactatatatatagtactctctatatatagtactatatacatctatatgtatatagtactatacatatagtactatatatgtatatgtatatagtactatatatgtatatatgtatatagtactatatatgtatatatgtatatagtactatatagagagagtactatatatatatgcatatatgtatatatctctcatttttttaatctatgaaaatttaagttatttccccctcttgactattgtgaatagtgttgcaatgcacatagaagtgctactatctcttcaagatcctgatctcagtacttttggataaaatcccagtagtagagttgccagattatggtagtcctattttttcttttttgagaaacctccaaattttttccattgatgccgcaccactttgcatttccatgaacggtatgcaagggttccaatttccaatttttctccttccttgccaacacatgttattttctggggttttgtttgctctttttttttttaataatggctaccctaacaggtataaaatgacatttcgctgtgtttttgatttgttattctctaatgattagaatgttgaacatttttacatatacctgttggctatttgtatatcttttttttttttcgagaaatgtatatcaagaccttagctcattcctgagttggcttattgtttgtttgttttctattgagatgtaggaattccttacatgtttgggggtctaacatatatggtttgcaaataattttctcccattctgtaggttgacttttcattgctgatcatttcttttgctgtactggagcttcatagtttgatgtaataccacttgtttgctttttattacctgtgcttttggtattatatctgtgaaaatactggcaaaaacaatgtcatgaagtatttcccctaagttttcttttagaagttttacagtttcagacctcaaatttatgttgataatccgttttgattttttttttgcatatggtataagataaaggtccaatttccttcttttgcatgggaattatccattttttccaacactatttgttaaaaagaatgtatttctctttcaacaaagtaggaatagaagaaaattacttcaacataatgaaggccatatatgaaaagtttacagctaccattatactcaatggtgaaaaacagaaaaagcttttcctctatgatcaggaccaaagtaaggatacgtatcatcaccatttctatacaacaaagaggagaagtcttaaaaagagcacctaggacagacaaagaaatgaaaggcatccaaacaggaagggaagatgtaaaattgtgcctgttgcagacaacatgatcttatatatggaaaaccctgaaggctccatttaaaacaataagaagaacaacaacaaaatgttagaactaataaatgaattcagcaaagttgtaagataaaaaaccatatccaaaaattagttgcatttctatagactaacaacaaactatctgaaaagaaaattaggaaaacaatcccaaatattgtaaaaccatttacaatagcacaaaaataataaaatcttaggaataaacttaactaagaaggtaaattacttgtatatttaaaactataaaaatcatgaattaaacgagacacacagaaatggaaaggtattttgttttcatggaaaacaatattgttaagacatccatactactacccaaagcaatctacaaattcaatgcaatctgcatcaaaatctcagtggtattttctaccagtaatagaaaaatccattttgttttttttttttgagacagagtatcgctgtattgcccaggctggagggcagtgatgcacaatcttggctcgctgcaacctccgcgctcccgggttgaagctattctcctgcctcagcttccgaactagctgagactacaggcacatgccactacacctggctaatttttatatttttagtagaagcagggtttcaccatattggccaggctggtctccaattcctgacctcaggtgatccacccacctcagcctcccaaagtgctgggattacaggtgtgagccactgggcccggccagaaaaaattttaaaatgcatatggaatcacacaaaataatcaaatagccaaatcaatcttgagaaaaaagaacaaagccagaggcatcacactttctgatttcaaaatattttacaaaactacagtaatcaaaagagtgtggtactgacataatgacatgtaggccaatgaaacagaacagagagcccagaaataaatccatgtatatgtagttgactgatctgggacaagaatgctaaaaatacacaatggagaaaggatagtctcttcaaatgtcttccatcattaatttattcactcaaaaatatacattgaggccaggcacagtggctcacacctgtaatcccagcactttgggaggccaagactggtggatcacctgaggtcaggagttcaagaccagcctagccaacatgctgaaaccctgtcactactaaaaatgcaccaggcatggtggtgcgcctctgtaatcccagctactctggaggcttaggtgggagaactacttgaacccaggaggtggaggctgcagtgtgctgagatcatgccactgcactccagcctggatgacagagagagagagagagagttctgagaaggtcccacacctcatggaaaacttagccatacgagatacagtccttatatcaaagcataatctagtgaggaaaattatatacacacactatatatttgcacacaaatatatatgtaatttaatcacagtgggctaactgtcatgtcggaaatctgtgctggatgtagatattacacaggtaatagaattagcccagaacactttatttacggagcatctcatggaactggagtgctaccaaacacatttttggaaatcccactctctatagaagaaaatatttaaagggtttttggtaagtgaacataaatcagaattttctattttgagatatataggagttggattggaaggttgtagaatctctgagttgtccaaataaatttagatgactgccgctagagaaaaactgcctttgtcgggaaagaaatgataaagggctggaattgttttacatttagtcacactaatagggatgcagagagcctgagaacctgcatatgagagatcacagattttgaaaagagccagagcttgggatgattgcccatataaaaatgcttaaatgtcttaaacataatttgagtggaattatttatatttcaagattaacatactgcttgatacaagttgcctgcacattttcctttaagtaatgggctaatgggctctgcgtctctttgcctaaattaaatgtagtttgcaacaattcaaaatgcaaatattttttaaagtagtctttttttttttttttttgactggcattcacaaaagctacagcactcttgtattagcaggtaaaatctggaccttatttcatcctggacaatccttaagctgagatattcgccaaatggcattatatctgctttgtaaatgttgatctcaggctccacttattttagccgctgggtgtggtttgtcccagagtctcctgtgagcttattttgctaagcaatcagttacactctaataattgatcagcctttctgtgttctttacaaagcagacctatcactcagcaagattttttaacactattttcatgaagtctggatctactgaggatttgatggattcaagaagacaaactaaatgactttttggctacctcaggatagacaggggacaagaagaaagcaaaaagcaaaaaaggaaaacaagaatcaaatcattttccattagacatgaatggctcaaactagtgctctctcccttataagaattaaatttgttttactcgcatagagttaggggtcagaatttctctattttacaaacagcatattttcccttttgcttttgcactttaagaacttatatgtgggggatggggaattgaggtgtctgatttgttagttgaaggttatggtaattttttttgtttgctcgtactcattttacaagtggttaaaactttggtgatcgacatgaagacccattttcttctcttgcttggactcagagataacagatttgtgcttaattcccagccaagaaattggatggaatgaattaccatgttgtagtaaagactttgtaatctggagaccttgtgattattaattcagaggggattcatcagggtctacctctgttggctgattaatcagaggatgacatcaaggtaactgggatattgtttgggcctcaagggttcttatagtgcaaattattaaataatttttattattaaatatttttattattaaattgattttattattaaattattagatgcactaaatgaagaatgaggatttattaacttattattaaagatattctgaccaaaaaagataagttgacatgaataagcaagcactctaaacttggagaaagtaggtttaggaaaaacttgaggacccaagactgattgacagcatgacactgaaaatcttctgagtttctggttactcactgtaaaatgcatgtaatgttcacctcatgggtttttgtgaaaatttagtgatatgcagaatctagacgtggtctgtaagctacacttgcaattaaatataaaatattattatttttatttaagttataattgccttttgaagaatttccttaggtcaattcatttacaaatggtaacatttaaattatgatatgccttgcctacattttcatggaatgaacagggtattaaaaaatgttctacatatcaaaccctccaaaacaaattagcaagtatgatcaagtattatgtagatggttaggggcttgcaggacaatggtgactttcgcacctttgtttttattgagttgtaaattgggaccccttttgtttattacatgatcatccatcttagtaactggccttgccttgcacctttaatagagtttgataagagtcagttagatttataagcaatgactttacacctaagggtgggatatgaaactcctggactattagtgagcaaaagatattttaaattacataaaagtgttatacagccttcaagtaagaaaataaacatttctaggttattcaaacattttttaacataatttttgagggggtataattttagatttacaaaactttataccttcaatttttgtttttaaaataatggtattaatatatcctatggctttggacaaatagatttaccacttgacctcagtttctggttccataaatcaaggggtttagactgagtgagtatgaaaatctcttctaattagaacttcgttgaccccattattaatagttatttaatgaactgatgttggaaaatgagaagcagcagtgttgctgcctcagatttgggcagggttctcttgatgttggcagtgttgttaatatggcaacacattccctgttcattcatataggtcaccaggaatttatgaggaaagaatgcaaattttttgaggaccaagtgagttccagagaccttcaaacaatgagactaataatagtgaacagtcattgagaggtctctgtgccccagatgtgtaccttacctcatttgatagtcacaacattctagcaaaagctcagtttatcaccctacattttcaattgaaattaaaccgggttaagtgattttcccaggcagaaagtgactgagccagaatttgaatctgtagtgtcctggattcagaatgtgaactattcacctttacaacattctgcctatttctagctgcagtttctatcctaaataaatcatttctgattgtattatatcttgattacacatttcaactagaaatttagttaaacacaaaacaaaacaaaacagcaactcagtaattaagaccagagttctgtctgcttttccttttaaaatatcttaccatgatataatcagactctaatgctacatggttattaaggaaatttttctgttatcagtttttttgtgtgtgtaggagtacttgattgttccatttattgcaatctatgttccatacctaagatggcaaaaccctaactctacaacagtagccaagcagacactctgaaaagtacgaaatgaatttgagattctacaaagaatctccacattttttttcaccagaaaaaaaaaattgttttctcacaaggttctgctaacagaaatatctgagataacagaatcagtaaactattaccttcgaggccaaaatacattctaaataagttatgttactgttgtccaaaccatgtattaataggtagaggaactatactctaggtaagtgggaagaaggatcaccaaacattgaagtttggagggcagcaggcagatggggaagaggttgtctctacagcctcagaagtgcaatttatcttcatgacatcagttagatcttcattgctcaggtcccaaaccttgacctaataccctgagagggcttcatcccgcaagattggatttactctatttacaagagaaactggtgtataattcacagcaacttaatacatttgcaattgaaactatagtgatacagccaactggacagctcattgtctccatttagagcaatagttcatacctgtaacactgcctgaaaagagcttccacagacaggaaacactcccggtaatgaagaatgtctgcatggactgcatgataagggttttgtgcaattgttaaagcatgagctctaactttacctcttctgtcttaaggattctttaacatagcaccgtggctttacccctgctacagagaattctataggaaaatcccattgtaatcaaaggattgctttgtgattattgagatgctaacagatgattttgtcatttatttgtattttatgtaatcagctaatgatatttacatacatctttctctatgtctactgtgccagggacatgaatgctaagtcaggacaaccatacctctgaggacagtccttggatgatatctgcaaaaattgcctctgtaattattatgatttttttcaatctaagatccattgttaaccagctcccatcttgactgccgtttttttttgtttttgtttttgtttttgtttttaatggagtctcgctttgtcccccaggctggagtgcagtggcgggatctcgtctcattgcaacctccacctcctgggttcaagcaattgtctgcctcagcctcccgagtagctgggattacaggtgcttgccaccacggccagctaatttttttgtattttagtagagacagggtttcaccatcttgaccaggctggtcttgagctcctgccctcgtgatccacccaccttggcctcgcaaagtgctgggattacaggcgtgagccaccgcacccagccgtttactgccgtttttttatattaatataatcaactacttttgactaagtcaggtaactggtctccctttgtagagaaactttgaaaacatcttttctcatttattttgctcttactccaattttgctctaagaagacaaacacattttccttattttgaacttggcagtaggagaagtggactgctgttgctgctttgtttttttcagcttgctattttccatagccgtgctgtaattaataatcttttgtagtcaatagtttctaactattcagttatcccagttatccatgggattcttaaaaaaaaaaaaattgtcccaatatgctttagaactgaactgcacttcctgcctgcctgtctgccttccagtgttgtgcttttccatctctctctcccttcttctgttttctcttctttctctttttttcccttcctaagttcttcccttccttctttctttgagaataattcaggccaaaagatgttttggggggtcagacaaattaggtagtgagtgtgtatgtgtgcatgtgtgagtgtgtgtaaagatgtgagtggggatgtgtttgtgtgtgtgtgtgaaagggtgtgagtgtgagtttgtgaatgttggatggcaggcagacagtatgcagcctggagtgttggagcccaggtggagtaaggggacatccacccagggaagggcggagagggaagtagtcagttgccagcaagatgagatggaaaagtgatggagggattaatccaatatataaagatatggagtataatggaagccagttttctcactattggagaaaagattgacagcatatggaaatagaaaacattagaataagagttataattttggcttgagattgaaggtatcagtgtaaatcacaattaaactgaaagatacattagatatgttgacgttctaacccccagtacctcaggatgtgactatctttagagataaggcctttaaagatgttttaaggttaagtgaggtcattaaggtgtgtcctaatccaatatgactgatgtccttgtaagaggaaatttgaacacgcaaagagagatggcgggtacacatgtgcagaagaaaggacttctgcaagccaaggagtgaatttccaggaaaatcaaccctgctgtcaccttgatctcagacttccagccttcagatccatgagcaaataaatttctattctttaagctactcagtcactggtattttcttaggatagccctagcaaactaatacttattggtagatataaatatgaaaataaaaatgaatgtcaatatgagtagaaataaatttagatataaatacgcatgcatatacgtatatgtatatctgtatgtaaatatatatactcatcttgtagcaggacgatccacagacaagaacccctcggacaccgagttgtggaaggaaaggcctttattcagctgggagcatcggcgggctcacgtctccaaaaactgagctccccgagtgagcaattcctgtcccttttaagggctcacaactctaagggggtccatgtgagagggtcgtgatcgattgagcaagcagggggtacgtgactgggggctgcatgcactggtaatcagaacagaacagaacaggacagggattttcacagtgcttttccatacaatgtctggaatctatagataacataaccagttaggtcaggggtccatctttaactaccagacccagggagtggctccgggctgtctgcctgtggatttcatttatgccttttagtttttacttcttctttctttggaggcagaaattgggcataagacaatatgaggggtggtctccgcccttaatctatattgcctcgctctgtccactaaagagggtctgggaactgcagtccaccgataccagtaagaaaaatttgtgttctaaatacctggttcttggttgctaaatgctgttccacactaaaaggaaccagactttttaaaaacattttactttaagttctgggatgcatgtgctgagcatgcaggtttgttatataggtatacatgtgccatggtggtgtgctgcacctatcaacccgtcatctagcttttaagccccgcatgcattaggtatttgtcctaatgctctccctcccctttccctctacccactgacaggccccagtgtgtggtgttcccctctctgtgtccatgtgttctcatttttcaactcccacttatgaatgagaacatgtggtgtttggtgttctgttcctgtattagtttgctgaggatgatggtttccagcttcatccatgtccctgcaaaggaaccagactttttagagaaatagctgattactagacctgggcagggaaaattcaagatgtagttggaacattttattttgtcaaaaagaaaagaaatgatcaaagaattatagggacatatagaggagagtcaatttatcaggcatcccactagaaaaccttgagattttcacccagtaagtgaaacaagataaatcttgaatataaactgatagaaattaataaatgaacaaatcaaatggtaaggaatcacatatttacatcatttcaaggtaatatcctgtaaaatatttatcaatcacaaataataaagaagtgactaactgtactgtaagaaatcttggcagatatgactttagtcaagtgctcaaagtgaacatcataagtaatggaacaaactaaatcttggaacagctgatagaataaaacaaggaaaacagagcatcactcttgtggcagtcttgccaaaggcataaaagctgaatataatcctgtgaacacattagacaaacccaaattgaggaaatactataatataatcgggcaatcttcgtaagtgtcaggaaagattgggaaatttccaggttgaaggagactagtattgacatgacaggtaaatataattgtgatgcatgatcttcatttagatcttttttttttttttgagaacgagttttgctcttgtctcccagactggagcacaatggcaagatcttggcacactgcaacctccacctcccgggttcaagcagttctcctgcctcaacctcccgagcagctgggattacagggacatgccaccatacccagctaatttttgtatttttagtagagacagggtttcaccatgttggccaggctggtcttgaactcctgacctcaggtggtccacccgactcagcctcccaaaatactgggattacaggcgggagccaccgtgcccagcctagatcattttttactataaagctgattattgggataactggcaaaacttagatgtggtctgtgggttacataatagtaatatattcatattaatgccctaattttgtcatcattttgtagaaataatgcaataaaacattcagggctgatggggcatcatgtcaacacacctcaaatgattcaggaaaaaaatataaattttgtactatttttgtaaattcaagatgaaaaaataagtattgctgttacaagtaatttatctgtccatctgtccatgtatctatccaccaatgtctttatccatctcctattaaagaaaactaaaatcagaaactttttttgaactcatattaattcttatattgaatttacaagtttatggagtctgttacctgagagttagaaaagataaaactcaggttccactgttcgtccagggactgtgatgagtattttcatctatattaccttatttacatttataatagttccaagaggtaagtttttgtatatgcattttacagagtaagaggatgaggctctgagaatttgaatggattattcaaggattcattcgttcagctcctgcacatcagggctcagaattcagtgccttctgccgcctggagttctttctgataaatcatggtaacttcatctggcttagggggataagcttcagtcaggcagtaagattctctggagcctttttgcagtgctagggatatgacaactaagcaaagacttctgagaaattgtcaagggagtccataaatttcagtggaagtagacctaggttagccatttaataatgagagtttttgccttggttttgtcagttattttttcttgtgactatttaagagactcagagacccagttgctttatccctaaaatgggcacaacttcctggcctgtaatttcattaggtggtttaaagaatacatgagatgatgagttaaaagtgatttgcacttctaaaggtgctatattgacctagcatgatgctgatttgtatttgggtatgagttgtccttataattagggtagaggttagaacaaaggaatacattctccctcatagatgagtcaatccataatctccaggaacttgtttttttgttgttgttttttgtttttgtttttgttttttcccctaaaagtttcaggctgtggtaatgcagtagagtgattgcataattgattccaatctttcattgtcctcaatccatttcccctgccctacaactatgtaacatcctcccaatcagactctgaactcaaccacatgacttgatttagccaatgggatattaacatatgtgacacaatcagaggcttgaagtcttgctgattgggtttgttctcacttgtcctcttctttaccctgaaaggaaatgctcagataagcaggtggtttcagcaggagggtgagagacatggaggagggctagtttgctctacacatccattgccttcctagatgagttgacagagagctgatctgtacacatacttagcgcacctaggagctgacaaaaccatctaatttactacccacagatagctcagttcaataaacacttattattgatagctcctaaacaatacattgtgattttagtaaggcatgcatatatactatgataaagtaaaaagcaaagtttctgtaactttaacatgaaaccaggagcttcaatattactttcgtacctaccagcttccattttcagcattaccttcagatgcccctatatctgcagcaatcgaggactgtatttcagaaataattaatttaggaaataaaacagcaactacttaagagatgctgatattgaacttccacctgaaatctatcccattgcacatatatctagggctcagtatagaaagaaagaactaagtatgactgtgacctagaatactccttggaaatggaaatagttaaatcatctaggagcttttcctctggaattatgggagctggtttcccttttctttttggatgggtgggaggaaaagtttgatttgaaatataaacctcttttagtgtaattattttataatgtcttatttgaaacaatatatacacagtcatatttcttaaattattattataattcaaataagtaaggatattgtaaatctcccttccaaatttttaaagtaatcttgctaatagcatttttttttttttttttttgagacggagtctctctctgtcgcccaggctggagtgcagtggcgcgatctcggctcactgaaagctcagcctcccgggttcacgccattctccggcctcagcctcccaagtagctggtactataggcacccgccaccacgcctggctaatttctttttgtatttttagtagagatggggtttcaccgtgttagccaagatggtctcgatctcctgacctcgtgatccgcccgcctcggcctcccaaagtgctgggattacaggcgtgagccaccgtgcccagccgccaataacactttttaaactcctgtgcatcatctgtgtaatgctatctttcttgcagcataacagacgtatttttattgatcgtaatatataatatcaactcttttttttttttttttttttttgagatggagtctggcactgtcgcccaggctggagtgcagtggcacaatctaggctcactgcaagctcctcctcccgggttcacgccattctcctgcctcagcctccagagtagctgggacgacaggcgccggccaccatgcccggctaatttcagtagagaccgggtgttagccaggatagtctcgatctcctgacctcgtgatccgaccacctcagcctcccaaagtgctgggattacaggcgtgagccactgcggctggcttataatgtcaacttttaaacttcattcctctgtaatggattttgcatggccaccttgcaggtagaatcagaaatgttgcagtcctcttttgaaagtgcataacaaaatcttgttttaagagaacaggtgctagggcttgtattctaaccaaactccagttcttagcaactgcattctaactgcagaattactcatacaatttgaactacactagatttctttgttcatctcttcttaattaataattgcaatgttagggaaatgcaaaagttgcataataaataccgagatagtttttttttaaatgatatatgtagtaaacatagtttaacttaaaaacaacatggagctggcatcgtcattaacaagctgtgtgattttgtacgtgttactttacttctccaaccattgccttctttatatgtgttaatatggaaaaatgtctatgatatatgttcagtaaaaaaagctgaaacaattgtatttatgctctaatcctgtgataatatagatgggattttaattatgcaagttcctaaagttagaaatacgtgtataaaagtgagtttttataacaaaagtattcctagggtactaaatacttataaaattagtctccacccaatcatccatcttcacttaacttttccactcatatatcatgcatgtgtaaatcatctctaactgatttctaaatgttacattccacaaaacaacataaatgcagggcaaatcaaacacacaatggaattgcatatcatgtactacatgcaatatttcatggatctctcatagtaagattgaagaattactcaaatcccacccaaaactgttgcccatcaattactgtatttgaaaaatagggggaaaaaacaaagaagaaagggaggaaggtagagaaggagggaagaagacaacatgatgatgatagagttggcaccgcaaaatattttctaaaaatataccaaaagattaagcaatctatgcaatcataaaatttgtagagaaaaattactcaaaagtgtcagcacatgagccatattttattcattcgtaaaattattatatggaacaattaaacctaagttttattaaatgtaaaacgatatactatctacatattgagttttatatttctaattttgttctttttaaaataaaataatgctacataatttaattttatccactttaaatggtctaacttcattcattttcagatacagaagatcttctaggtcttctgtatagaaatatatacacaccatctgcacacatacacacatatgtacaaatacatctatctatatatgtatgtatatatgtatatatattccagtatatacatacatatgtgtgtatatatattccatgtatagtgtgtatatatgtatgtatatatgtatatatattccagtatatacatatgtgtatatatatattccatatatagtgtgtatatgtatagacacacatatacatgcatatatgtatatacactgatgtatatatacattgatgtatatatgtatgtatatatgtacatatacatatatgtgtgtgtgtgtatatatatatatttatgcacacacatatatattccagttttcaaatggagccaaaacactggatttgctggctttttcccattcaagtctagaatagactccagttctccctcagctccaacatggatgtttttgaacagtcagggaagttatagatccatggtcagtatttcacagggcacttgggatatctagctatgtttaagtatgtacaattagtaacaagaggagataaagcagaagaaactaatggggttgcactttgagtgaacttttaataattcagattgaaagatagacttattttcaaattggcctgtgatatgaatagtgtggtacaggaaagaagatcagaggataacctagaacctggaggacaaaaaaagaagtgactcatgccacgtttttttttttttttttttaaatcatggaaggaattctaggagataataataaaaccacacccagtaagatatataactggttatgaaattcttccaaattatatattcaaggttatatatttttgtctagtaaaattgaccaagcaacaagtgcccattttgctttgtgagagaaaattgcatcaatttttggataccttaaaagacctcattaaaagagactattgaaagattattataaatttctagccacaacaagggaactttccttgactaattaaggcaataatctcgtgccagaagggcctggacaagggttatttctttccgggttgtcttctggttcaatggcataatagattacaacaattgactgatctatctcattgatacttattgtctgaataatcatggccttgttacctatagcttcaacaatagcaataataagacaaacaaaatacacaaatacattctgtctctcacacacacacacacacacacacacacacacacacacgcacacgcacaatccagccttggaaatttaagaacttgtccagtcgggcaaggcaggacctggaaaaacagaaccaaatagatgtgttcaggaggaagtccagtgaaacaggcaagtggataagaggcaaagacatagacagcgtacagttcaggcaggtaataagcatgaagaaggagacagcagtaaaacataaataaattaattaattaattaaaacaaaaagcatcctggaacccaaaagcacaggcagaaagcagaaaagaggtatctaagaagcaatggtctggaatccaggcagaaggcgtgtggtcagcaccagagagcacaatcagcggacaatcatgctttgggccatttaaaagaaatacatttaaattttacacatgcagctcttggatggcattgggtgagtgcaagacaaagccctcacactgggcaacctgtcaacaacatggaacagtggaactggaactgactttggagtccaacagtgctgagctcataccttcactccagcatttacaagttgtagatgagtacaacttgtacagttaacctcctcatctgtaaactgactaataacatctctttgctcatttgaagattagacaaagtaatatacatgtgtaaaacacaaaggatagtgctcagcatataacaagtgtttatagtttatgaattttctttagagctagggaaaaaaatgagtttaagagcaggttaaccacaagaaatttatgactgaattcaatgtgcatcataaaatacattaaattcttgttgcccatacttacagagttgaagttagagctgattctagcagacaatgggtgagacacgaaatggtttcaagtaatcctgggtctgcacagggaggtgggaaatgcagagggtagggagccagacaggagagttggttttatgcagaaaatgccagcagattgattttctaaagtaagagatttttaattcaattccctttgcacctcttcctctgcctgagattctgctatattacactctaaaatagctattatcactatctgttacaaagctgatgcagaataattgagcatgtccctggagaaattacacaaacaaattccttaattctgcagaattatgcagggcccggaggggattcctcatgctcccctaccttctcatcaatgttggataattagttttctgtctgaggcatatttataacatcagtggagttatcagtggtcaataaggtgatgcttgggtgccaataattgggaaacttgacattttccaattagatgaatttctcagtgttgattgaaagatccaataccggtcaccattttctgcattattttctgggtagctcagtgggacacactgagagagtatggattagaagagacaggggccagagaagggggttggtaaaaataaggattgtgttgctggaggcagcaaaacatattttccctcatctaaagaaatttcccaagagatgaaccagaatgcaaatgatctgtgctgaagtcctcgagtagactgtgagtttcctctagttcaatgtgtaatatgaactcctagcataatgcttgccacatagaaagctctaaaaatattccgtttatctttggtgaaaggctggagggaaaatggtatattcaacattaataaatatttaacatttaaaaaatttttccttttgtaatttaccccattgtctacctccagtgaagactaattgctagaatacttcagcctgccaatgagaaaacatgttcagcaagggaagtcgggatagtaatgtcctgtattacccttgctggagggttctgtaactatccattttgtcttacttctgcccggccatttcactccactgactggttctatcatatttccatttcccaataggactcttctttccattaaatccagtggctttgctagggaatgaaaagacttgggttatgacatagggttgtcatgggcttacattgcagctgcacctctctaacttaattgggtgactccaagattcctttgtgtttttaggatcttttctttaatgatatctaattccttgggttgtcctatgtaattcatgtgtaataaacatggaattgtgcaagaccccaagttgaaagcatcagttaggagttagaccatgtaaaacctatggaaataatgaagtgtttcctccattagctagaaattgaaggagtatatcttgaagatgtgttgcagggctaacattctaggatgctaacattctatatcagaaaatccagtacctacgcccaacttcttcactcatatgctgcagaaatacagaagaaatgtacctccatacctgggacttattagcattcgggtacttggtttcaatcctaatctgagacatactaccagatccccacaccctcccctcccccaaaaattaaagcttgcatttccaaactattgacaataccaaagtctgttctcattaacgattcattaaatatccaatgacataatatttgccttagacaacacaaagtagagtataccattatgggttgcttaaatcacaaattgagctgacttcaagcaatgactcccatgagattaaaatacagtatttgaggaagtagcatgcagagataaatggaatgcttactaaagagagagagaaagagtttacaataccacttttggtatagaaacaagaatctaagggaataaatctgctttttcaagtactatttttaacatttgttacatacactttgtatttaaaaaaaatctcctgacatttatggttaagaagtagcttgcaaaatctttctccagttctctcatagaggaggaaaaaagtctgtaaatattttcagaagacaagtatgcctgtaatactatgaaatgagattaagttaccctactagtaatatgatctttgcattggaagcaaattcctttttgtgatttttttcctgagttggttatacagcagactagatgacgatgataaaggtatcaaggtctaagtttttatttttattttaaaatactgtttttttttttaaatcagatacatgaggccacacaaaacaactacctagcttaatgaactgtttcaagtcaaatagctttgcaaccaccatagcggtcaatgagtaactttgccagccagcccagaatccctgtcccaagtgcttcgtctcaaacccacctacctctctgccctacaacctagcctgacttttatagtacttgctgccttaatacttttatatttttataattcaaatatgcatccatagacactagagtttatccaactattttttttctatttggttatgtcttttgtgtcttttttagtctacatgttcatccaccattctcttcttttttttaatttaaaaacacaattcattgttgagggactgggcccattcgaactgtagtttcccacagcctggaattcgagattgcagtctctctgaatccagccaggccttcatgactttagcaggactgtaggtggagttgcttttcttcaacaggtgcaaaatgcataaatccactaaataattgagggttgaaaatggtgatattcaaaatccatatttttttttacatattagttgaaataattctgtaggaatcacttgctctcatctcctatttagttacccaatgatattgttcatataggaaaggcaggataaaagccagatatttaccagttttcaagataatgatttttttcctatcatctttgaaaggtgatcattttttttaacatggcagtatgaacacatggatttaaacttacttatttgatgcattttaatacattgcaattgttaaccttgtggaagctaaaattgtctcttatttgaagatgatattttctatttaaaaaatgctgactaatgtgtattgactgataacttttttgagtactttatatgtattattcagcgtaatgctcccagaagtcctcaaagtatcctttcacaaattagaaagctgaaacacaaaacatttcagtaattctccaaagttctcttagctagatgagataaaactgcaatagaagtcagggctaccttcttgatcctgctgcatttattatggtacaagcttactaatcaaattttttaattttcagatttagtttttgtctcctatagcaaaaagatgtatgtgagttatcaaatctacatttatgcccattttaccaaggaaatggagacttagagaagttaagtgatgggttcaaaaacatatagtatatgtgcctcataagagacaaagaccaaactctagccttgggcctcctgtcctttgaagcagtattgtccttcccatggagtgatcactgaagtgattggagatagttgacaatgtacctccacatgatgtcacaggcccagtcccggtggcaaatctgcttatctgtttccaagtagagaaaagtgatcacacacaaacacacacacacacacacacacacacccctttatgggaagagaagaatgcacagttttacaacaaatagcagtgcttcatgaatgttgcaattctaaagatcaagtcaggaacctttctaaaatgaaggcaaatggaattgtatgcaggttattgtccacagcggtcataatatctcaatgtctgatattctcttgaagtttatatttttaattattgtactttctacacagcttcagcattttttttttctaaagacaaacgaataggtaggaggataactagtgagaaccgcaccccccacacaatcaccacttcatgttttctaagatgggtatatttgcaaaaacatgtatggatctaaattctcttttatatcatatccatctttctttggagtctacagtgcatccatgatcattgtgtacccctgagttactaatttcttttataaatagaagggtttgctgaagagaatttttcagtgctgatttctgaagttgcttgttatttaggtatttttgattaggtctcaagaaaaatatatggagtctttaagatgtttggaatagaagtgccttcatagctgaatgcgaaagaatccatggacacttatttgttatatatgctgggagctggtgctcggaatacctcagagaataactcacggaagtctgaatgagtagggtgggggaatactgaaaataaagtttcttgttagatacttgaactaataaaagtttctcccacaattactcagttctaacactggattaaggcacatccccctcacctcatgatatttaagtacatgtatacttgccataaatactctgtttatctgcaagatgtaattagatctctaaaaaagtgacagttcacaagacagttatgatatttcaatttagtgcaaacctgtagatttaattgcctcaaataacaacacagattgtatttcaaactcttcaggattcaggatcatctgttatatgttagtacattattacacggcatactgtaagactgggtttacaacaaacagatgcaccaaaatgctatgcttcccaaaatgtggactttagtttttacaggaaggtgaattaaaattaagatgcagatgagcttcttgatttcacagtatgttttaagtggaattgccttgggaatgaaaactagccccagcacagtagggtgactatcacggacagtattgtattttatatttcaaaatacgtaggaaagatgattttgactgttctcaaagaaattatcaacgtttgaggtaatggataagctaattaatgtgatatgatcattacacagcatatacctgtatcaaaacatcacactgtaccccgtgaatacatccaacgattatgtgtcaattaaaaataaagtaaaactttacaaaatcaaatgagctactctgaagcatttgcaatgacttcatagtttaaactgggatagaatctcaaactagaaaagggcaaggagcctgttctcactaaccatgtcactcttggagcagatggcctttcctgaaggctgcgacattttttgcatatccctttatttcaaaggctgttatggtcatgaaatggaataatgtgaggacccctaagggagctcaggcatgttcagaaatacttgatgagattatcttccaatatgaatgtgcaaggaagtgttttaattctagtcataatttaacaagatgaaatcaagctaaagatgtaatatattaattggatcttgtgtaaccactaaaagcagtgctagagacctctacatattgatgttaagacatgaacgacatgtgaatttctatgtgaaaagagcagttatgaggacggtttgtatgatagttgggttcttcctttacacacaccgtcctcatgctgtctgctgttatactttgtgtttgcctccctgcagtggcccagcctctgaaatgttttgccttcctccactccctcactgtgttctagtcccctaaaaactcaaatgactttactctgaatatctgggatctgacaaaccaattgccatatggccagtccatatttagaggagatattgtgagatctctaatctgttgctaccactattactcatgagaacaaagatccctcctactatttcttagttttttctatagattaaccttattctctggtctacaattataatcatagttttgcaaatacagattactcattctattttagttccagggtggcaaattctcaatgctatttaaacccattgtccagtttctctatatccacatccaaaagagcagaacattgctggagaaaacctcttaaacagaagatgggctttactttgtattaaaaaatgagtcaactctgtctaataatcttaccacaattgtgtaaaaaactcatttttatactgtaaagaaaaatgaattcatagagcttctttttttcctaaaagctactgaccatcctaagtacttcttgagacaagggaagactttgtatttcatgaggtaatggaagatctaaatggaaacttcctcatcctcccaacaactaacctcaaaatccatttcctcaatgtctgtcttctcattttgcccttctgttaaaattaactcagtgatctgccttctaccaatggccagtgcgttcatagtttgattcctttcatgcatacttgctcaatgatttggccatttatcccttctttctgttgaaacatacatatccctttcttaaatggtcattgataacattttataaacgtagtttagaatttctcatttttgaaaaagaaagaaaaatcttatttccttctcatttatttcctgctaccaccctatttcttctacctgttgtttttcctataccaatatttctctaagaagtcatttatatattctgtcactaacctcctctcttcattcttcaaccattgcaacttggatttctctcagaccactgtatgaagctgctcttgtcaaggtcaccaaattcagttgccccgtatttgtcttcatcttctcacctcacagcttcatttgacacatttgatgatgttctcctatttaaaacactttctggtttttggttacatctcacttttcaggattcttcctgtctctcaggctgtatttcacaatctaacttgaagcctatttttttttctattctcaatcttaaaattttcaaattccacagggctccttcactttcctttctactgccctctcctatgttatctcattccttcccagggagttaagttacaatcttagacatggtgaagatgtttctggcagtgtgctctagagctagttaaattctgggtaagcctggtgaatctaacagtaaagttgaggcatgaatctagttgctactggtaaggacttcatctctctcagagactgctgtaagcatgggtatagtgtgagaagtgggcatgtgagctgcattggctggcggcagccctcttggtaaatgccgaccaatggcatctgcccttcttctctctgtggcctgctttgccctttctgtgttgtctggtttgtctggtgagaatgtacctttgctgctataattttcattaggcaaatatttctctttatttaaacttttaggttcaggggtacatgtgatggtgtgttacataggtaatctcctgtcatagggttctgttgtagagattattccatcacccaggtattaagaccagtaccccatagctgacttttctgctcctctccctcctccaagcctccaccctgaagtagatcccagtgtctgttttttccttgcctgtgttcctaagttctcatcatctagctcctacttttaagtgagaacatgcagtatttggtttctgttcctgcattagtttactaaggataatggcctccaactccatccatgttcccacaaaacacatgatctctttctttttatggctgcatagtattccatgttgtacatgtaccacattttctttatccagtctgtcattgatgggcgttgaggttgattccatgtctttgctattgtgagtaatgctgcaatgaacttacacatgcatgtgactttatggtagaataatttctattcctctgggtatatacccataatgggattactagttcgaatggtagttctgcttttagctctttgaggaattgccatactgctttccacaatggttgaactaatttacactagcatcaacagtgtataagtgttcccttttcttcacaacctcgtaagcatttattttttgactttttaataatagccattctgactggtgtgagatggtatctcactgtgattttgatttgcatatctgtaatgatcagtgatattgagcttttttttcatatgcttattggctgcatgtatgtctttttttgagaagtgtcttttcatatcctctgctcactttttaatgtttttttcttgcaaatttgttgaagttccttataaatgctggatattagacttttgtcagatacataattttcacatgttttctcccattctctaggttgtctgtttacactgttgatagtttcttttgctgtgcagaagctcttaagttagttcccatttgttgatttagcattttttttcttgatcatgagcctgacactggtatgggtgctgggactgagacaataataacagttaaccctgacatagaatttactttgtgccagacatgtttctaagtcctgtaatacgtgaatttatttaatcctcacaaataccacattttacagatgaggacacgtagactcagtgaggtgaagtaagtttcccaaggtcaaaaggctgggaagtggcagagctggctttgcacccagaaggtttggctccaaatccttgaagtcaccagctggtgagaagagacacaacactcgctacattacaaggtggtaaaagatgaaagagaggtttggaacacgtggagctctagggaggaaggtcctttctccacctgggaatgatttccagaggcaatagccatttgggctaggatttgacatttctaacaaaggagtagaaacaatctcacaagagagaaatgcattgcaaattgcagaaacaaggaagggtgtggccatcttgaggcacttcgagactttcatggtggctagaggataagcttgtgttgcttttgctgtgaggaaggagatggctcagaatgatgcaaagtcaccagcttggccattagcaggctcagctcaagtgcctattgcctgaattaccattcttccttatctctacaaggcagttacacaagaaaaaccccttgggtgtctctcagctaagatttttttgtagttatagaaaacctcctaaaccctaagccatgactcagctttcctgcagattaatctagatgatctaagcctagttctgtcactgcacataactcaggccccacctcctattgcataccatttaaaagcagggtgagcagcaatcaagacctgctggaactgagggggttcctcgattgcattacattaagtactgaaatatggtaattgcagacaaatcaggaagaatgggataaactatctgaagtctacctgatgtgccagaaataagatgcatgacaactcataatgcaaagacgtcaaattcgcatttctctaaagtatagaataactgttaaataaatatagagatgctcattttagttttacattcttttaacctctactattctagttattttctcttatcaggtttgtgttgtctaacaggtctgcttccgagcttaacctcatattcttgggcatttctctccctatcggatatatagtcttccatgtttttgttattttctacaaaggaaagtgctctattttttgattatttaaatattacatgttccttctaaaaatattaaatatataaaaaacataacaaaaaattcaaaatcacatgaaattatattactctgagataaccaccattaataatttgttgaacatacttgcatttgtttgtgcatatgcatatttttgtatgcatgcataaaatttcataaaatcgtattattactccttcctaacttattttcccctctcatctatgtatttttttttctctttcttcctaataccatccagctgatcatggtaaccactgttgatttcttggagcatagacttcagttgagttcaggtcctcaagatgcagattccaagacaggattatatgtgaataaagatgtatttagggaattacctacacaagataaagggaaggaaggagaagttgagaggagcctttaaacaggcctgacttccatgaaggaaaagagaaagtctgagactaccgtctagttctgaaaaagtttggctaagccgagggggattcattgaaccaaactcacccagttgagtacttacaacttgaaggaatgggcctctattatgagccatgctgtgtccagtcatcaggtgctagtagcctgtatgaagagtggtcttagtatgaacaagggttggacccagaaggacagcagctggtacgtttcctgcaacccagaaggacagcttgtatgtttcctacagcagatctgagcagcatgtagcttccttcatatttgtatggcaaagtgcaaatgcacatgcatgcataatggtccttagtcattgtttttacaaatataaaatcattttatgtacactaaatattgctcttgtcactaaacagtatcaatggaaagtcatccaagtgcagcaaatataggactcattcttttcaagggacaccatactttccaatacttatatatccaaatttactcaagccatttgttattaatgagaattctcttgaggcctaaatataaagtattaaaacacttgtaaataaaaaatttacaagttttgttttgcttaaaattaggaatttaatatatatatatagtaagtcagttgtaacacttccattttccttgagcttccaaaattttgttgacatcaatttttttcattgtcatcatctttcctattaagtttatcttcaagtattcatgtttttaaagatatatatacttaatctttttaattctcatttttgctttgaggaataattaaaaataaaaatgtgttaatatatcatatttcatgatttattgttacatattaacttttaacttattttttccagtttttaaaaagttggtattttatttgcaattttatattaagaactgatttgattttcaggtgactgacatttttattattttttattgtatccaagaataagatatgtcattacttaagttcaggctatgttttatttctttcaataagatttaataattatttcctcatatgttttataactttcttattaaattaattcttatgtatatgatagtattatcacttctgagaacagaatgttttccatttttacttatattttggataagtatcatatatccaactaccttaagtgttcctttattaatttgattgcttctttaattggccatcttgttttatctagatttattatgatattttcagtaaaattatagttttatttttctttcaatctttatctgaatttattaaaaatgttaatcatattttatgtaactatagtattaatagacacttccatcttatccatatcataatagaaatggctttagtattttggtttttaaaagttgtaagtttttgtgaaatgtctcatattaaagagtatttcctctttttctattttaatttcattttaaataagaaacgactggtttatttaattaagtaatgttttatgtattgaaataattatatgactctttttctgttagtttttcaatgatgcatgagtcttataggtccctaatatattaactaaatcattattgtgttctacctggtagtatttattgaagattactgtatctttgcagacatagatctatttctaatataccaatattcctgttctataattttctttcttttactctctttactgggattgatttttcatttcatgcctgcattaaaaatgaattgataaagtgtccatctcttcctatagtctgtaaaattttaattatctttgtaattgtctgctatttaaaaagaaagctagacttaggaaaaggaagtatgttgttttaatgcctcttgggggaggaagggataaaatctttaatcatttacttgcaccttccaccgtaaatggcctatttaaatttgctgctttttgttgttgttgttgttaactttgctgctttaaaatttacagtatgccatcatttttacctggcctttaaaatgtattgaaatatttggccaggcaccatggctcacgcctgtaatcccagctctctgggaggctgaggtggacggatcccctgagctcaagaatttgagatcagcctgagtaacatggcgaaacctcgcctctaccaaaaatacaacaaattagccgggcattgtggtagacacctgtggtcccagctacttgggaggctgaagtgggagaatcgcttgagcctgtgaggcagaggttgcagtgggccaagatggcaccactgtgctccatcctgggttttgtatttcttcccaacactcccatccttaaaatggatcctaacccttgaatttcaagaaatatgctagatcccaatcacatttctcagttttgcttaaaccagatttgtctattccaattctccaccatattctctgtctcatgcagacttgcatgtgtaaaataaccttaactgtaatatctagagaaattgagaggaaaagacatagaggtgaggagatgtcagctcctgaaagatttttaaccatcataagccatttgaacttcaatatgagggcaataggggtagggcatagaactatattaagcaccaaagttacttaatgagactggtttattttaaattctctacttcttttctcttaaagtggtcgttaataacatgcatcttggaattagacaaaccttcctacatttatttgatttatgactttaagcctgaggttccatatcaataaaaattgagacactaattttgttttcacaagggacatctgaaatattacggtgctaaattatgtgcacagtgcttattacatagtaaacaatcaataaatgatattcaatcaacaatcaccatcatcttcgtcttcatcatagtttctatctctattatgttacagatataggtaaatgtggtctttttagtgaagcatatagatttttcccacagtcttgattggaaaagtgagagtatagctgattgagagaactcactgtcagctgccaaccaatacagactgttcaacttttgtttttattttgttgaaaggtctttctcttgctttcatagcttgctgtaaatactgcattctaatcactatgatataaatatttttgataaaagaattaatggaaaagtaattgtagagacaaaaaactgagaaagtttggcattaattatcttgaaacacagtcagtccctctgtcatttgcagatagtcactacttttaaaagcaaatagttctattggtcatggcaactctcagtagcagctatgagaaataaccaactcatggctgaatatagtaaaagttttttctcaatcacatcacagtttaatgtttgttgggtggctctcctgagcagcaccattcctctggagtgacgtggggacctactgcttctatctagtggtcggccttgttggaattttctatttctagctgtaagggcaagggacacagagtgggtggggaggggacacagagtgggtggggagggcaccctggctctttactccctgaatcctaacatggcacactgcacttccagtcacgttttagtggccagatattagtcacaaggtcaagtataaatgtatatttcagccttctgatatttgcacacagacttcctgagtgtgcagaaagagaaaaatgggcagtttaggaaacccagggatgtggggaggtgagtgtatacccacgtatataataagccagcaacagctaaagatttagaacatggcatccagatccatagtcattttttaaatggacaaataccatagtcattttttaaaactttgatgagattatgaatgagaaacaattgaacattattttttgaagccattatttatttatgacatttcctattcattttacatttttttcacatacgtaaaagagaaaaattggatgtacatatgcgtgcttaacagtggaatagtgttgacatattttcccctcagggtttcaccgggagttcttaactaaaaaatatgtatcctcataattaattaagaatgttattaattttgcatcaataatcattatctaggtgattttatttcatttaatcatgcaatatggctatttctacctctgagagtcagcctgttccctgagattttttctaattttttatacccagaaaacttagtatttatgtatattttcagaaaaagtattaggtgaatatttatatttttattattttattttctttaaatacaatatgtcacatacttatatatgtgatatgtttcacatatatcaaaacatcacatatttatggtgaacaatatgatgttttgatttgtgtgctataaacaaatccagctaattaatatatccatcatctcacctacttatcattttttgtgatgagaacatttaaaatctactcttttagcaattttgaaatatacagtacatcattattaactatagataccaagctaattatgaaactaaaattttctatctttttgatgtttcaacaatttcaatattttgaaaatatttaataactgaagtgttattcatttgagtatcttaagatgatatattcaaagagagatcatacaatatgataatgctattaagcatttttacaaatgttcaatgatattaaacaaattaaaattaaaagtacttctatttgtgatgagctcttaatacataaggggtcattttttgagaaacagctgttatattactttcttttctcaggtatgtagttaacagataaaagtttagataatgaataaaatctcacagatcacttttccatgtgcatacattgtttggataaacaactgattaatgatgtctcatcctttcaatcagaaatgtatttgtaggaaataaaaagtgtgaatgcttgagctgaggctgtcagtgatattattttgcataattatattttctgttgattcattttgcatatttctttggatggagcttctctgaattgattaaaacttccattttatcacctatttgaatttaatttttgctcaggaaattctgcttcgaatggacattttgatgcatcatattcataagaaaaggaaaagaaagcatagaaggtgaggggcctgggagtttccacttaccttgatccctgtaccatttatttgctggttaccagttcctcctctctgatatgtggttgggataaagttaatgggtaacctttcaggctcaacatttctcagcgtaacacttctctttgaaccatagagaaagagaaattcttagactctaacactctatcttgttgctcttaagattccaggtgaatccggacacaaagtgcctattttacacaataggatcctgttgtgctgagtgtgtcagagcataggctggcatctcatagctcttactgttaaaagaaaaaaaaatatggcaattatttctttgtcgtgagatgacattctctgagtgctcagtatcttcttaactcagcaggaatactctttgtaatatagaaagcatacaagacaaaaggcaccttcccaatttgtgtgttctttcttttaatcttgacaaaagtattgcaggcctctttggtgccagattctgtataataccctgaaatgcagagaccttgtgtgcttagatgactaatacaattagatgacagggcaaaaagaacactgttgggaacgaggttcaggaagagtttgtcataaggatacgaagtggaagggcattccccgccagagaaagcagcagcaggaggagcagacctaagatggaataatatgaacatatggcaaactataaatttcatggaagacttgaatgtgaagtgttggggaaaatgccaggtaggcaggacatatagccacaccctactacagagaatcattgtttctccttccttacacatttggtcttctaggcagtttatctcatgtacatggagagtgaatatgggttctgacttggccttgtacagccagttaatgacttccctggattccaacaccaaaagattcagtctctgaaactagttaatagataattggaaaaatgctgcaagcagttttctcaggatattcatactcaggatccaggttgtagctcctgttttgtgggtaacagccttgactttcatccttcaatccccaccaaacacacacagacagattttgatagataagccagtctccagtggcccactttatgcaatctagacacctaacagtctccttgtttccatctgaagctgatttttgttttttgatcggcactaccactctcaggcttggttgattggagaatttgtgatgcacacctgtcctcaattccagaatgctgggaaagtcattgacatgactttcttcagatgatttggtttgggccgtattaaattttgactatttcaccaccttctaatctagtacttagattcattccagcgttggaaggtatgtaattctgttgtgatattaaggtcactacagaatcagggcaaagaggagaaacacagaaaaatgaaaacaaaacacgcaggcttctaatgagaagtcgcatgatacagactttaaaagcatgggtttgtgagcaagacctggcttgaaattcctcttgttctacctcttattcgccatagagatgattgagcagttgacataactagtgacttagtttcgtcttccataaaatgtttttctacattattagcttactgtgatgaaaaaataggataatgcatgcaaagctccttttcccagtacgtggcacttaataagccctccgtgaatgttaactattattcttactttcatgatggtttgtaatcccaagaaaagataacaaccgtttttccttttggcttctttctttggttgttttattttgtttgtttgcttgttaagtgttcaatagatatttgctattttttaatataacagttgactgttcttacttttttgggaggtggatgtatgcaatgtattaaatatggtaaattttcagaatcgaagaaaaatgcttcgttataatacatcatggaatagcacacgtgtgatatcttaggtgttggaccacctgagaagtaaaggattatcctctacattttgaaaagttctgtgggtgaaaagaagaaggcatggccaaagaatccgaaattaatggattagttatctctcaaaaatggaatttagtttataaagttataattaataaaataattaataaattacccattgggacagaaagggaaaacatatgaaagacatatgtttatatcccaaaatgctctgacgaacttagatttgaaaagaaaagaccatgtcaggaatagtcacatgagggttacagatttttgtctttattatgatgtggtattttgtttggacctgagaattggtagtgatagattaacttaccaagtagtagatatttaatcaataaaaaatttttctaaataaaaaaatagtcgtctgaaacataatgggctttgttagtgggaggttgtttaggtcaatacaagataatcactggtgatgttgttttgctctgctgtgggaacaaataaattccaaagttgtagtgtcctcacagtaaaggagtttatttcttattcatgtagagttgctgtaggtctggtgactcttcacagcaatactcttccaagcgatacctgaaggatccacgctgttttcacctctgtctccaccatctaaacccacaggttccatggtcatctttgaagggcagagagagacaaaggagccccatcagttcttaattcttcatattggaaatgaagatttttatggtcatatttctgtttcctaataatatttatacttagctcccattctgtctatgaggaagtcttggaagtactattttcctgtgatataggaaacacctaacactctcggccactaaggatatttctcatgactggactataggacaatcctaaatctactgtcagaaattccgatgattaataatcagggtttgcaaaatttatcaaatgaatctttaactaaacaatgcctggaaaagagtgtttaaactggagaaatacacactacccacagttaaaatttagtgtctgcctgggtataaagaatgtattatatctggtaaacatccatccctagatacataagagcactaagaggcttctcttgtaaatctcctctgtgtgtataggtagttacacttgacatttgctttgcttgttcaaagctgtctctaatagctcagctaaggagataatatgtgagacaaatacatataaatcaatctcatatgcaagatatttctgtctctataaatgatcctgtactccttcttgccatctctaggagcttaattccttactccttcattgaattgtcctaaatcctgctggtactgcttccaaatgtctcttcagaggtagtttctttacaccattacaaatgatttttttctttaatgaaggccctcatatttcatcttcaaactaattaatgaactcatatatattccacttttttgtagcacctcttcttttgcagctgcagctgccaaaatcatacacctaaagctgaagacagtaaggaccattgtagttaagcctggacatcctggagtgagacaccctgtaaccttggacttttcttagcctttctccttagttttgtcatttcttaaatgagagataagagtatcttatgggcctaaaagaggaagataatgaaaatattatacattaaaacatcatggcacaaatgaactagaacggatgcaggccatagttggacaaatgccatacccttcattgctggatcatggaagcttctaggagtattcttgataaggaataaagaggcaaagtcatgaaggaggacacacttgcctaggttttggcagtggtcatttatcagcattacaggagcagtttagtaatttaatattagtgtgagctacctatcagctgaacatcagctttagtttagttaactctgtgaaaacactgaacacagtgtacagtcaaggctaggttaggaaatgctgaagtaacaaataaatccagatcttcaggtattaacaaaaattagtttattctagaatgatggatttagcttgggaacagagcctggagatttgtccatagctctaaagcacttctccctgaaggtggccccctttacttctgcacatattccattgaccaaagcaagtttcatggtcatcccatcattaaaagagtagagaagtactcagaagaggtgagttaggcatatcgaagagccagggtaatgtctaaatatatgatgtctagctcattgttaagtgctccagttattattaaagtgtattctgattttttcatttctcagttcaaattacgtttattggatctgctttacctccttataacacggaaactccttgttgtcgttgacactcattgtgatgtaaatcctaactacattcctgtttatatgttatactgcttcacttcattttacctttggtctgtccaagcagaattatttggttttctcatcaatgcattgtttttctctacatcactgcctctgatgtccctttaccattagtgctttaactgaatctctccatgccagtaagccttctaacatgtcaggttctcaagttcaaatgccctaaatttccattcctgatatcaacttctgtagtaatatattccgttaactcttattttgctgttagacccaacattatattatagtcatttttatatatgatgatgtagcattatagcctgaaaacttatgaagagtccatgcctgattcatcatgtagccccacttgtgagtaccttactcatagcagttcaataataatactaataataaaattcatcataatgttacatttagtggtggcatcagcctaatgtaaaatgagcattggattagatattttaaaacttctggattttatttgcaccccagttactaactagcagtattacctagaacaagctgcttaacctattggaatttcagttttctcaactctgaaatggatgagaaggaactttaactgattttccccttctgtcttacaatattgttgggagaaccaggtcagatatgagatcatagtatgtgaaagtattttacataaattgtcctcattctgatgtaccaaagctaaactctggttttaagtctacagtggattgattcttcagtagcatttaattctgtttcccattctgttttctccacggaatgcttcttagaaaacgttttgggtttcataacattttatctttctggttttctgcctatgtctcctttagctgaccagtacagctaacctttctctttatcccttctactctacactctttgctagataagttcattcataccataacataaattcccatctatgtacaaataactcacaaatatttatatcctgtcaaagatctctcatatgagtgataaatccaggttcttggttggtttctctacttggatatactaacatgtctcaagcatatcattgccaaaaccacactcttgattcacacttgccttcataagtcttgcaattttccagtgtttatttttttctgcaaatggcacaaccactttcttagttttaagtgttaaaatctaggttttctctttcttcatccacaatgccaaaagtactgacatgctgcaaaccttaccatgtgttcttattccattaatgagaatctaagccaaatccccaccctttcttataccttccaaggaaatactttcttaactggtatttctttccttcatcaatctattccctatactgaatcttttcaaaatgtaaatcctatgctattacttaaaatagttaccactgtttgggaataaaggttaaattccttaacctggccttaaagaccacatgcaatgtgttggcatctacttctgtagcctcatctcctgtcaaacataatgttctctctacaattttgtcttgcgaatactttccatagttgttatttttactatttgattgattagtcaattaaatatatatttttctcattggagactttgagtttcctgatggtagggagaggtgatcttttttatatctcacataacaagcactgtgctttgcagacctcaagtacttaataaatatttgttaaatgaataaagagtttagtaggtagacctgttttttaactgtgtattgagattgactttttaagaggtgcaataaaggcacaaaaaccataaatattaatgggcatgatttgaccttcaaggaaatcaagatctattggtaaatatgcttaaaaacagttaagattgaggggaaattttgcactaaggaagcagcaaatcttctcccggaacgtggtttgatatatagggcttgacagaagaagcttccgcttctgatctctgattttctggaggactcatatgtaaaatttctcaaacctttcagtattttctgttcaaagattataactgtctttcattgttatgtttccttcaatgtgacaggtctcagtgaccacacattcctcatatatatctcaaacctggaaaatttcagagtactcaacacattttcaactataaattccccttttctgtgcttttagatatctatttatctctagtttatgtgttgtatttttgttgtagcttgattatttctcctcgactcaatttattataaatgtttccatacataggtatatatattttagaaaatctattaatattttctctatgtcttctaggttttgtatcctgttaatgaaagcctgctctaaactcccttatttaattgttaaacatttgacatgaaaaaatcatccccttaacttataaataacttatattaatcaataagaaatatacaaataggccaatagaaactagacaagggattgaacaaaaaaggcagtagaaataataaataattttagagaaaaaatgttttccctcgcatttaaagacatacaaaacaaagcgatatgagttttgtaatctgttcaagttgataacaaatgtttcatctaggttatggagcagtatttattattatacatcactatttggagtgaaaagtagtacaaaaatttggtgaatacatcaacaatgtctgtcaaaatataaaagtacatatctttccttatcagccatactactgttgtgaatttactcaacagattattttcaaaagaatagcgagatacttctgcaggaatttctgttgtacaaccctttgaactatcaaacaaaaaatgttggaaacaagctacctatgcattaataggaatgtgattagataagtcatattgattcatccaaagaaaagtatgaagcagatcaaacagtttaaacaattgaagtggcatctgtgtgttcaagtggtaaccattaagaaacaaatatacaaaaagcccatggtgaataactagtgattactttgtataaataaaaatgtatatacaaatgtatgcaaaaatatacatgaaacaatttttcttgaaagatacattaaaaaaatgtatagacaatgaatacctttggggaggagtgcagttaggaagtaagggaggtaataactcttacttctcatttttttcatttcataactatccttgtactgttttaagtatttattacacagtatgtgtattactgtcatgttttttacaaaaataactgacattaaaccattttaatttctatgcttcacaaaaaatttctaaagctaaggattttaaaaattcttcctccttttgtggaagtgaattctatacttgaacatatttaatattgtataatgtatcctcttttctttgaactgtagccctcagcatttttttcagctcctcgtgtgttcttacttactgaatctatccttattaagctgctaattctgctatcaggaagttcttggtaagttcttggtatttaggattgtgcaacaaaaattgaagtcaactattttgtacaaaaaaaaaatcattattctacattaacagttgattttggaggtacttagtaaagtcgactcaatcatagacctccaaatggaacaaacacccttacttgcatttcattgtgatttttgcaggccctttgcagtaatagttctgaaaaacagtcagaaataaacaacttaaaccctcaaacatattttatatgctttgaatttaaagcactcatttaaaagaaaaattcaatcaggtggttttttttgtgtgtgtgtgtgcctacatttgtttaggtttcttcttttattttttatttttggcccttattcctctttcttttctactttcccagaaattctggtaaaagtaatgtaaaaaatgtgaatacctgatcagaggagttgcttaagaaatgtctcagctgaaaccagtactttagtaagagtgctagctgcttaacaagtcaagggtgtgaggagctatgaataaagagagaacattttgccatgaattattcagttaaccatgggatgctgttatctccacttcagtggcttttaattgcacatgtaagaattctgcttatctggcattcaatttgatgccaaggtgcagcttgctcaagcagggctggaggcaggaaatgaggatctcatcagacaagcagctgccattcacgaatgcattaaagaatatggcatagactagcagggaaggcagaagacagacacagataatggcaatggaaggatatgtgagaatatgtgacaagagattgtcttttccttttgatcttattgcacattgctgagtcttgagtgaaaagtcaaattgtgtgtgctacctaaatgtactgcattgcctttgttagagacccaaggttgacctctggagcaaagatgacaagttgctctttaaaccattctcttggaaaatctggtattctttcagtctaaatggagtcctgactcaattttgagattctgttggttttaatttttcaaagtttacttcagataagtttgtttatcaagataaataactttctcaaagcctttttcttatatcaaatttgcagaagagatatcttttggcacctgtgctgtaaatgtttcaaaacaatttacttataaaataccattttaaatattttcagaagatttcatttggaaccccttctccatttaaacctctccgcatagtatgtgattcctttatattattgcatacatccatttccaaattgaagtgcttatgcaacacatgagtttcatcagttaccatttgctgtgtgctgtgtagtgcataggagatgtagagattagaagtatccacagataaagcacccttaccttatggagttcaaaggctaaaatgaagatgtgcaacacaaatctgctggtctgcatggctgttgctgcatgggaagtttatgccagacaaaatggaagcacttttgagggtttgattacccaaggcttcctgggagaagggactggagaaactggaagagacctcaaaaaaggcttccttcagaagacaacatttatgaaatatgataggtttgtagacatttctaaatttggcgaaagaagaagtgcaggaatttcaattagtatagccattatggaaaacactatggaggttcctcaaatgttaaaaaatggaactacaatatgatccaaccaatccactgctaagcatatatccaaatgaaatgaaatcaaaataccaaaaagatacctgcactcccatgtttatggcagcactattcacaacagccaagatatgaactcaacctaagtgtccatcaatggatgaatggataaggaaaatgtggtcttattacacaataaaatactattcagccgtttaaaaaaaatgaaccatatcatttgcagcaacgtgggtgaaactggaggtcatataatgtcaagtgaaataagccaggcatacaaagacaaataccacatgctctctcttatatgtgggagctaaacaagtgaatctcatggaggtagagtagaatgatggttaccaaaggctgggaagcatagggcagaaggaataaagagacttgtttaatgggtacaaacatacagttagatggaaagaataagttctagtgtttggtagcacagtaaagtgactgcagttaacaatatagtgtatttttcaaaatagctagaagaaaagatttgaaatttgttcccaacacaaagaaattataaatgtttgaggtgacggatatcccaaatacacagattggatcataatgcattgtatacatgtatcaaaatatcacaagtacctcataaatgtttataattatgtatcaattaaaaaagaaaatgtggtatacatacataatgcaatactattcagccttacaaaagaagggatttgtgtcattttgataccatagataaacctaaagtttatgttaattgaagcatgttttacttaaacattatgtaaatgaaataagccaggcacagaaggatgaatatcgcacaatgtcatttacatgtgaaatttaaaaagtcaaattcttagaagcaaagagtagaatggtggttaccaggggctgagaggtgaggggattgtggagatgttggtcaatggacacaaaatttcagttagagagaaagaatgagttcaaaagatctattgtgcaacagggtgcctatagctaataattatgtattgtattctcaaaaattgcagagtggatagtgttatcaaaagaaataaaagctaagtatgagaggtaatacatatgttaattagctccacttagcattccacaatgcatacgtattttacaatatgttgtacacaagaaatatatacatttttcatctgttaaaaatagaaaacaaaaacaaatctgtaaggagaaaaagtttagtatcagaaattaaagaatactgaatttaatcataaaaatggcctctgaaagaaagttgataatcctgggggacagcataagaaaaaaagaagaaaaaaagaaagaataaaagatttagagctgtggtgacaagcttggagggttggaagaatagcaggttattaaattactttttgggacaatagggtgcacaaggcagaatggcaaacaatgtgtgaagagtgcacatggtgaggtgccaatttgtgaaatgaagtccatgtggatgttattctgaaggcagtgaagaaccagtgaataattttaagcaggagtgacgtgatcagatttgtgatgcagaacaattgttctgatgacatcgttcctttggcacagttgttgatggggctccactataaaaacgaacacaaaacaaacaaacaaacaaagaccacttcatattagcatttcctatggggccaaaaatcaaagggacaatatagattaattgaaacagcagatcatttgatatcagaagaattgggtcttgttttatgttcttccattttttagcaacataatttcggacaaagtatttctcctttcccattaggtttaagttcaacgtatgtcaagagcttaaaacaatttctcatgcatgagtgaagcttcataagtgtttggggaataaatgaatggatttctgggtctccgtattcttctactaagtaaggaggatcaaaaaaatgttctgagagtcatcttccactactttggaagtgactacaaagtgacacatgagattagaagttaagtgaacaacctatattgtatcccttcagggaaattatttttgtattaatattgttagtctggggaaagtatagtgggagaggagaaactatgaatcaattttcagacatctttttctcctctgttttgttttgtttttttaattttggcagtctcttctttcctgccttctcttttgctggatgtttttatattcctacattttaaatatcttacttccaaggatgcaatcctgggacaccttatctttttgcttactgggcatttctgtacatacttttcccccatgtacttcttttcccttatattccactgtgctttccttccttaaggtctcaaaaaaaaataattcctgctcccctcccctcctagacatctaatataatctttccaatgggcctgagcttttccaaaaggcaagcagaaccatttaattaggttgtgtttagtttctgcccagtgaaagtccctgaggaaaggaacacaaaagcaggctgtcacattgaaatatgtgagggttcatagttggggaaatatagaaaaaggaaatgcttataacttaatttattggattcagcatagttacttctttgatattgttttgaagaacttgatgtgctagacaactgccttttgtgttcaatctaccatctgaagtcctcacttctttactgtaattgctgaaaattctaacccccaggaaaggggacaaatttcctgaggattttatcttgtaaactcttgcagcaccagtccctagcccagtgtttgagacataataggtttgttagtaaataaacaaatgtctctaggcacatgctgatggcttatttttgcagaaggctgaagctgctgctcaggaatttgctcatcatcagcttccttctagtgacacctatatcttcaattgattctggactcttcatctcaaagcaatgagtgacttttatttgccagttctatgctttggttaatagttttccaacgttttattattttgttcctctaatttctactttttttggttgcagttattcaagagattgtgactaaatgctgcattcttagaaatttcttctctgaatcaacctctagtttgaaatgcaatatataattcccaacataccaagatcatgtgtcttattcctttagataaagtttactatcttaccttgtttcaaaattgtgagcatgacttttataataactctgcattttattacaggagggcaggtaccatgctgtgatcttcctatcctggggcctagcacagggcctaacagaagtcgtcaatatgtgtttcaattgaattaaattgaatgaagtgtaatttctactcaaaacttttatagttataggaataagaacaaattttacaaaaatcattgtaagttacaaattaacctaaaattacacagtcatatatatctagcaggagaatttagacaaattctatacaattaaaagtaaagttgaatatatcattgatatttaggtattatttttctgagaagagaagcttgatcatatcagaaggatccctacatttaagagaaaataatcccattgttttgttgcactagcttaaaaaaatctttctatgaccttgaactcggtaaacactgaaaaatgcaaagtgtttcctctcaagggcctcttttatggatgtttcatgaattttcgggatgatgctgttcatctatgttaatggattagaaggaccattgttctaaacagtgaaagataaatatacagtccctcataacagttttgacctaaacttttgtcatatttataggttttcttcctctcaacaatttattttctctcatggctttgttaaattaggtagttttattacaaaatttctttgcaagctttttaaaaagtctcaggaaactgatcacgacaaactctagtgaaagtctttatttccatggtaaccataatatgctctaagtatcttctcatgaagaggtagaaccaatgttaccagcaaaacacagacaaaggccaataaagaaggaacacacaaacacatgttcattacagcaatggtgatcagggctgcagtcaccctcctttcaatatttaattcattaacgcaagcagattttttaatagtataaaaacaaatggagaaaagtacaaaatatgcagtgacaatttttgatttagaataaaaaatgttaaatgccatttattgttaagttcttaattttgtaagaaaatattttctgacatctaggctaaaatatcaatgaaactcaagtttctctgatcattgatattttagcctagatgtcagaaaatattttctgttaaaaccccgatagtaaacaggtaagataagactctgaaagctatatggtttctgtgcggactacttggcaataagtaaacaaataagtattgctgtgttacaataaaactttattttaaaaaacaggtaatgtgccagaattgccccttgatctatagtttgccaatctcgtttattataaggtaaaggtagtattattcatattctacagatgagcaaatggaggttctgagaatttaaacagctcaaggtgaggcagaatcagaacacaaaccaagtctattgcattttaaagcctgactcctaaatagctacgcttatttaataagaatagctggcatacactggtgcctaatgggacaacagtgtgctaaattgtttatgtccattactttgcttaacttagaaaatccctgtgagataggtatgattagcattctctttttatatatgaagaacagatacttgggaaatctaagaagattttcgaaggtcaataaaatagtaactctatctttgttcaaattaacttattctacttaattcagtgactgaaataatgaaatcattttttaaatgtgacctctatgatctcaagaatataaaaaggaccatgcacatttaaagagtacctgagttctggtggatgctttgagatttgcaatgcttatttctcaatctgcagctttactttgattgtaacttggtttccattcagtctactttatgaggtgtaatttcatgaagaggcaaaaagggtaattgtagtgtgcagttaattagaatttctaattaaaatcatccttaaaaaaaacagccaatgccaatggaagaatgattactaatctgtaaattaaggaaactgtatactgcaagattttttttttctactggattgaaaaacacccagtttaagttaacatatcataaataaagataatcaccttaaataaaggtaaaatgcatagggcaataggttgatttaatttggccaaatgtaattcagttaaatactggggattctgtaactaacaactaatcttgcttcacttcccctccacagccttcaattccttctttctaatgtttgggcacagatttgattttctcaaataagggctcagtaaacctgtcaggctttcacaattccattcgtatgtctatacacaagcacacatgtgcgtttgcgtgtggttggcaagaacacatgtatgtgttaatgcatgcctgtgagtgtgtgtgtctgtgtgctctgtgacatatgggtaaaatttgtagcatcttgcttgatactcacaggttaacttcttgcttcaactccatgttgtagcaacaaacatttccccataatctcatttcaccaggtgtaggaaacttcaaactatcttaataacttaagaatctttctgaagtcatgcagaatctgttcattctgcatttgtggccatggttacataaaaaagtaatcattgggaaaaaatcttatttatctgtatagtaatagtcaaaattttgggtcaagctgtctctgaaaattatgctaagagctttgatagaatatcaatacagtcactccttggtatctgcagtatctgtgagggattggttccaagatccccaaggataccaaaatctaaggatgctcaagtcacttttataaaatggcataatatttattataacctatgcacctcatcccatttatatatctctagattacttataatacctactacaatataaatgctagctgaatagttgttatacttcattatttattggtattattattttctatgtgtgcttgtttgaatccacttatataaaatctgtagatatgaaagcctactgcatcatgtttactttttagcatgctaaatatgtaaatatctttttgaaaattaataaactgtatattttcgagcagttttagatttacagaaaagttgagcccaaatacagagttcctatataatcactccccccccacagtttccactattattaacactttttacaattgaagaacaaatatggaaatattattattaactgaagtccgtagtttccattagtgctcactctttgtgttctttgggttttgacaaacacatgatgtcatgtatccaccatcagagtataacacagaatactcacatttccttgaaaatcttctgtctttcatctattcatccctccatcctcccctggttcctggcaactactgatattttttactgtctctatagttttgccctttctaaaatgtcatatagttgggatcaaacaatacgcagtctttttgggcttatttttatcacttaatgatatgcatttaggattctctacctttttttcatggcttcataggttattcctttttagctctgagtattatccaattgtatggatgtaccatagattgtttattcttgtttatttattatttgcagttcttctattgaaggatatcttggttacttccaagtgctggcagttatgaataaagctgttagaaacatttgtatgtaagtttgtaagtttgtgtgtgtgtgtgtgtgtgtgtgtgtgtgtgtgtgtacataacttttcaactcatttgagtcagcacctaggagcttgattgctgacagtaagagtatatttagttttataagtaactcccaaactgtctctcaaagtggttgtaccatttacattcccaccacaatgaatgagagttcctgttgcactatatgcttgccagcctttgttgtctatgttttggattttgatcatctaataagtgtatagtggtatctcattttgcaattcactaatgacatgtgatgttgggtatattttcataggcttatttgccatctgtatatctcctttggagaggtatttgtttagatcatttcccactttttaattaggttgtttctttacttattgttcagtttaaaaaattccttatatatttttcatacaagttctttctcagacagatacgtgttttgcaaatattttctcccagtgtgtggtttgtcacttagttttcttaatggtattcttcacagagcagaagttttaaattttaattgatttaaacttaattgataagtcccacaccaatttttttctttcatagatggtacttcatataaaattaattgcccaaaattatagagatagaaagtagaatgatagttactagaatatgtgtggggatgaggagaatgggaaattattgttctatgggtatagagtttcagttttataaaatgaaaagaattgtggagataaatgttggtgatggttgctcaatgttattattgtatttaatgcaatagtacaacattttaaagtgtacacttaaaaatgtttaagatggcaaattttgtgttatgtgtattttaccaccaaaaaatttggaaaaaacttcttcccaaacccaaggtaacctagattttttttccttgttatcttatagaagttttatacagttttatattttacacttagatctatgatctattttgacccaatttttgtgaacaatgtaaggtccgtgtttagatacactttttttgcatagagatgttcagttgttcagacacatatattaactttttgtttgcttctttattgatatttatagtatcgaatcaatatttccaaaataagaagctcatcaaatgcctgtgttttagggttcttctttgccatttccttattgctaggaattcagcatctaggcactcatttgaatggatttgtttgaatatttatactcgtcagcaaaaaaattcccttttcagtcttagttgctttggctgctacgaacagggtggattcttttgagtatatgagagtatttgaggtcatggatagaagagcttcattattcaaattccatatcatcagaaaaatggggaaataaaatgggaggtaaggatacatatctcttattaagtagctttgggagatgtcagaatataccacatgtaaacttctgttttcacaaagggcagggggatgagtgagcacagggacctgccacagtttctcctatgtagcttctgatcatttctgttaaatggtatggctcccttcttgcactattctttaagtcttctcagttagatcattcttggacatctgttcagcttaaaaatcagatgttctggggaaaatacttggccaggtttgtaacaatttcatcagagatagtgctgtttttaaaggtaattacaacatatatctgcatctggacaaggaccaaaaaagaatgcagaagagggaaaaatatctatatgtgttgtgtgtgtgtgtgtgtgtgtgtgtgtgtgtgtgtgttttatacacatatacacatgaacacacataaatgtttagtttcctcttctttcctaacttgaaactatttatgacaaaatagtttacatttatatagcatcatggtcaaagtgctttacatttaataatttatttaatccaaagtggaaagaagctcccttttttaaattaacatcaaagcagtttattttcagggtgggaattcaaatatttgagcatactttttacttggcaagtcattttctcccctaggacagataagaggctattaaatctagcacagcagactgagaattcagcaaatcaaatgacagataaggaattgaaatatgagctgcatatcaaattctgaatttaggcagtttggagaaagaaatgtttcaatggttttaatgggaatttgtgttttaaaagggtgtgttcaagaaatactgggaagaggattaaaaaatagtgacaaaaataggtgaggaagaaaagcacatgattgaacattagaagtaaatgcctaaaatatctgtacttctcagttttacaaaacaatcaatagtaaggtgatatgagaacattctcctttagctcttgctctattaaaaaaataatactgattcagtaacagtctaaatcccaagtgaattttctccactaatgccataaataactcacttcctgcaggcacatcatttttcactgttgaaaattaaaattgttaagtagagtattggcaagagagaaaataagccaagctttcataccttgttcttgttgcttctatatttacgtgtgactgaatttggttggatcttaagtatttggtactgtgtttgtcataactacttgtaaacctatgtcttctagtttagctttaaacattacgcttgtgatttctataaaaaccttcatgttttacaagaaatgaaatgtgttattttatattattttgcctgtgacatggaactcccaagtatggttatttttggtccataagcatgctactcatacagttccacaggaccccatgctaaaaagggccttccactcggttgagtgctctgccatcactattaatttttgaacaagggcctctacattttcattttgtactgagcctttcaaatcacatagctggtctggtatgtttgaataagaagttcagtaacaaatagaccaaagtctcaatctcacccctgggccttgcagccaaatgaacatggaaaagctaattggcactagtgagcctattctacccttatttataacccttatttataaaataaggattaaaactgtctctctcaaaaggctataatgggaattgaaaaaataaaacatttaaagagcctcacaaataaggcaaatacgtttttgttgttgttgatgtttcatttgaatttatttattttttgagatggtgtcttgctctgttgcccaggctggagcgcagtggtgtgatctcagctcactgcaacctctgcctcctgggttcaagcgattctctcacctcagcctctggagtagctgggattacaggagtgtgctgccacaccccaccaattttgtatttttagtagagacagggtttcatcttgttggccatgctggtcttgaatttgtgacctcaggtgatccacctacctcagcctcccaaagtgctgggattacaggcatgagccactgcacctggcctgttttgtttttaatctcaggagccaactccattaaatttgggtggcttcctggtaaacttcagccagaaaagctaacgctaaattcttatctaggcaatagatattaatgtgtataaattaagccacaaattattgggttcatgagtaaaaccttactttgaaaaactctagcttgaactttgcaatcctcactttcctttgggaatgaatatttttatttttccacattctctcctgttattagggcatcaatgttagttcataattgttgcctttttttctgcttaagtgatctcctatcttaataatcaaaacataatttgttactttggagaagggcactcaggtgaaaaatgagaatgcagatataagcatgatgctttgacagaacgccagccattgtcttttagcattggtttcttatgaacaatatttctgtgctatgactggcctcatttgaaggtatgttctgtatgggaggtgaaggacacagtgcttttggctgcagaaatctggagagttggcacagggttttaaatgagggatcaagatttactggaggatctcttccccaagcaattgttgttgctgttgttgttgttgttgtttgtcattgtcttttttggggggggaacggggggagttttggctgtatgggtgagtataattaataaaaatgcgtcgaagactgcaaataaatgagtttatgagagggaagaatgtgcaggtaattgtgtaggctagcccagagatatacccagctctgctctcaactcataaggttttttttttaatcttaattacttttccaaataagcctttctaattgaaaaagtattcttcaacaagaataattaaaactatggaacatgaaagatgggtaattagttagctcattcatatcaattgacagatgaataaactgaggtcatacaatttttagtggactaatgaaaataagcagaaagtataacctatctgaactctaagtctgtgtgagtttaggttcatgaacgagtttccccagaacttaatcaactgtgcactaaataacatagacttttagttctggagggcagaaccagccttgagagttttgttaactacagatttttactgtacactgtcctagtcacagaccacccacccctcttctccggctacacagtagttacctcctcctcatgtgggcctgccagatccactgcagattcttaaatagccattgctgtaccaaatgaaattctatctgagaacctgttttgagggtattatttcttctctacaaccttgtggccatctcacctacactctctaagcctcaattattcatctgtaaatttagcataatgataattatctctgctcagcctccttcaaagcactgaattaatggaaagcttagaaaacatacactgaagcactttttagtgtgctctatcaattgaatattatagtgttcatattggctttttataataggtatactactattattgatattaacacaataatgtgttcaaactattgaaataggattacttaaaaactgcgttaatattcaatagcttaaatctgaattgtaattacttttagaactttatacactaagtgatttctaaagtgactaaaatagggaagaatatttcttgttttgaaggagcataatgatttgcaaatcatggatgataggttcaaagaaaaataattggttgaaaaacaaactgttgggtaccatgctcactatctgggtgacaggatcattcatactgcaaacctcagcatcatgcaatatgcccatgtaacaaacttgaacttgtacccctaaatctaaaataaaagttgaaattattaaaaaaaaaaaaaacaagaaaacgaaacaaagctaaactgagaaatatttaggaatatgtttattatccttgggagaagacaaggagaagctgttggctgtttgatgctctaacaaaattttcatcaaaaccgtattcccaaaatggccttgaaaggcaactacattgactgtcaatgataacagcaggattggacagcatggttgttggttacttacagtctggaaccagaatgcctgagtttaattgctggttatgccacttatcatgaaatattaagcaaaatacttggcttctctgtggtttaatttcctcagttataaaatgaggataatctaattgggttgttataatgagtaaatgtgaaaatattgcttagaacagtacttggtgttttaagtatttattaaatatatttcttaactggtgatcaattagattctattcaccatctttattttatcttgtgtttagttgcttttgaaattagaaaaataaatcaagtagcatgtcatcatatctatacaatacatattttttaaaatgtggacatcattcaaatgctcaggcttgtagaatttatgtatattgttaacaattttaatgattttgaatgtaatcaaaaagatattttgaagaggaaatggattggataattgtgatctgttgattttttcatgctaaaaaatcatgttttttcatgtttttcatgttttcatgttttttaaatgatactgaaatctttgcattaggacaatgtttctcaaaatgtgacccaggaacccctcaggtgtccatgcctatttcagagggttcacaaggtcaaaactattaacaaaataatactaagatgtgatttgccttattcatgctcattgtctcacaagtatatcatatttttccaagattacatgacctatagtattacaaaagttgaatgcagacacagatctgagaactcaactgtcttccattaaaatagtcattaaggatattcattaaattgtaaaacaacaccactctcgttaattttattttgtttttgaaaatgtatttttataaaagtatatgctattcatataaacatgatgtgttagtactatacattttaatgaagtaatacataaatatttttaattttcaaaattttaattctttagattaattattaatagatataactggcttaaacaaaagctccttggcatccccagtaagttttaagaatgtaaaggggtcctggaaaaaaaattaaaattactgcattagactatctgtagtctcttagaaattcatcttgggcaagtggtttaatggagttgcacaagtctgtggaacaaccaagaggtaggcccaacatcatccaggctctccagcccaatcttctctggatgaatggaacaactagcttctgtgtgttgtttctttcagttctagagccgctgatatgacagatggacaggccatgaatcagagagcacaggggttctctgtttagagtcagtaaaaacatgaatttgagtgacatttttcaaccagagctcctgatatttggaagctggcagcaatacatatttaaaacagtatgtaggcacagagagaaagtaatgtgaaagtgtaaatagtcgatgtgatgatactcagagatttaaaaattatatttccattttgaggaaagtagtttttttgtgttgttttacaagattgaattgctacataattttacaagtcatatacatgtgtttatatacatttgatagttcactataattgcaaaaattaatttagcttcccttggaattgagagctgctgggttcaaaatttggcagacaagtacaagtgagcacaggcctacccaggacctcctggttccaaagtgagcacaggcctacccaggacctcctggttccatccttttcccagctgatatggtttggatatttgacccctctaagtctcatgttgaaatgtaatccccagagttggaggtagggcctggtgggaggtttttggatcatagggagcaccatcctcttgatgatgagtgagtttttgctttagtagttcatgtgaaatctggttgtttaaatgagggtggcaccttacgcctcctgcctccttctcttgcccctgctcttaccatatgacatgcttgctccccctttgccttcctccatgattagaagcttcctgaggctctcaccagaagcagatgctggagccatggttgtacagcctgcagaactgtgaaccaattgaaccttttttttttcttttttgagatggagtctcgctctgtcgcccaggctggagtgcagtgggacaatctcggcttactgcaagctccgcctcccgggttcaagcaattctcctgcctcagcctcccgagtagctgggaccacaggtgcccaacaccacgcccagctaatttttgtgtttttagtagagatggggtttcactgtgttagccaggatggtcttgatctcccgacctcatgatctgcccacctcggcctcccaaagtgttgggattacaggcgtgagccaccgcacccagcctaaaccccttttctttataaattacccatcctcaggtatttctttatagcaacaaaaaatggcctaatacatcaaatttctaatattagcaaggaaccattcccgcagagttggcccagtttcccagagccattccctcattcaggctgtctcatatttggttatattagcctcagatgttgaccagtaattaagcttatatttggttctactctttacaacatggggattgctggcctacgcattgcaagggagactcacctcctctctgcgttaccccagtgctttcttagcacccagactctctgtcagtctcccttaactctgttctctcccagatcctgcttggaaaattgccgctgttcatatcaattatttttcagaaaccatggatgcattaccaaaatgtagataagaaatggtaacgaaagcacaacccaaggcattcattatgaggttagacagaacctctttctttggatgctaaagcaggcacctgggaaaaacaaaataccaacccaaaccctgaagaaatgtcactaattaattgaaggtgtatcactcaattcagaattgagacatctccagctgcattttcaaccagatgttctttcaggcatgtagtgtcactactagagagaaacttcaacagtcctgattctcataatgagtctattgaaatatcaggtgggaagccttccaggtgtgagatcacattgctaaaaaactggtaatgaggggcaattctgcttcatttcaatatttatatagcttgttaagggaactttctactaaagacacccctcggagtctaaaaaaaaatgcattaagtaggtggacaggggctttgattttccctccctttgaggggaggtaaatgcatagttccacaagcttagaatacaatgaatcaggtaactgagataatattatcttctgcactcacactaccacaggattcactttttcatgtatcatatatttgcaatttcccattgactagggtaattggcaattcctgtgagctaacttaaaaatctgtttttctctttaactaaaacatagtataaaatcaggatcaaatatctgttctgcaactgtggaaatggcttatttccagaaatgtttaggatgtataatagtttgtacccagatgtagttatagaacagtcactgaaaaatggttgttttcttgcatattatttcaacctcccacccatgttaattgccagtgacattttgggttgtttttcaatactttaatgagaactaaagcttctgaaggagtcttgctgtatctaccatctgattgaatttgatgtcccaattattgatgtctttgccagtctgtgaaggaaacccaacctccaatgggtgaagtagcagctaggttaggcagatattttatttaatttttagctctagcaaaacttaacggtaatgatcaagaatcttgtaagtatgaagtattaatcttgaataggcatgtttgtacagagttcatgtctctgtatctgaagacattagcccctagggtaatttattatgagacacactgaaatttaagttgtataaaaacaagttatcggaggaagctaagaaggcccctaggtggagcagaggtactaaaccctcagcttgataaatactgaggagggaaggtcattacaataaatattgcctactcaaaatgtgatccatggacctgtaggatgctgtagcattggcttctaccacgggcttgttagaactgaatctcagtccccctgctccccacagacctactgaaccagtttaacacattacccataagatttatatagatgctgcaaaactccattaacaaggggttgtggtgcacctgtgctcagcttgggctgtagagtaccagctggcatgataagtgaggcagctgggattctgattctgacactgttgatgctcaacatcaggtagggaccaggttggtgtgccacctagatcttgcagtttggaaccaaagatttcaatgaattgccaaggtgttgggtgcaaaggaagtcagtatcaaagaaagagaggttccatccatgtaggggccacactatggccaagaacgctgtcaggctttagttcattaaattcagggctacagaccaagatgaatgagtcattgcccattccatcaagacatcaggtgattaaaacatcaagataaaaatggcctcaagacccatccacacaacatgggttaaggcaagagtcctggggtttccctgaggcacatcagctgtcagtcttggggaccacatttcatattcttttcactagtgggaaagggtttctcaggttctcctgagcatacggcccgggtgacgggcttccattgagttcttaaagcctagaagacaaggattaatgtcccaacctattcagtttaaagtggaggagtgcagcaaactcaatccaaaaaataatatccctaagaaacagtactttttgaaggataggcatcccaaattgatattttcatgaatgaaatggggaaaaaatgataatgatacaaaatactaatgcaactgtgcggtttaagtgcagtcaaacttggcaggatcccatgataaacattcatagttttaatggcatctaaactgtagtaacaatcaacgagttagtaaagcttgaaattagtaaactcaatttgattcagagtttgtggtgagcaattctaatacttgtgtgttcttaaggaattacctttgaattttttcttttaaatatgtcaaggtcttaatagtattgactttctttgactgtattatctctttgaacccttgcgtcaacactgttaaataaataatcttagccttatgtttaaaattaggcttagagaggttaagtaactttcccaaggccattcagtaaagtacaactcacaaaaaccttctgaaaattttccaattgactctgtctactattccccaaggattttgaatctcattacttaggcctttgtgagttatcaaatcttttaagcaaaaaggttttctttcttcagtcacttattcattcagttacttctatcttacagggcctggggacctgtaggtaaaaaattgtcacaaaacaatgtttctttagctttgatcccattctgcagagaactctagtttttctccagtgccaacaaagcatttctgggaaacaccagaggttttatcctttgtattctgaatgaatcccatttgctaccacagattgtgtgacatttctttccttttatgcttaggttttctgtggtcactgtggattaataaggataaacaaaacttccaaaataaatacaaacaaacatgtaatggctcagtgaaacataagattatttatttctccctaatatagttcagagagcttccaggtaaagcagtgggcaggaagataggggttctctccacatttattaagggattctggatgatgtcagttttgccatctttaatgtgtgatttttaaggtcttcctgagggtcaccagtccaatcggctaaaagaagagaatatgaattgagtacatgtggggaggttttctggggccaggcctggaaatggtacagaggatgtcctcttacatttcactggctagatctcagtcacatggcaaacaatttctaggcaggcaaagaaatatggtttgccttgtgcataagaagaggaggaaatgcatttttcgtgggtagcttgtactctcagtgagactactcatgtgccaaatggaagccatggtaccagcacatagcagaggcagtcactgccactgctcatgtttataagatcatttcccctgctgacagtcatcagccaagactagaatgcccacattcaatgaaaatgtgaccctcatgcagctatctatgctgctgactccatgcctctaccatgttcagctgagcttgtggagattggaggaaatagacgattaaatgttcactgctgttttactaaagaccccttgcctggacatatatctaaatgtgtatatgttgagggattgtcagctgggacaggggtttaaacccataaaagtgttctgtgttgtcctccaaatcatgcttcctttctaatgcttgggtgaagcagctttggctcagacttagacacttgcttaatatcttctaggtacttgaagagcttatggcccaatgggactaactgatgcatatacaaaaaattacacaatcaaatctcaatttcctactgtttattcttcctttgttaatttctcactctcttagtttatttgaattctgctaccagtttgtctgtcccttccctttgaccctgttgtttgcactgttcttagagtcaagatttcagtgtcatgataaaggaccagctcatcacataataagagttgtaagagtagtgacccaagaacatataagggggaagttctctactgaagggtctgtgaaaatttgttgccccatggggctggaccaaagccttgctattgatcttactgaacaggtcactgttggtcaggaatgtgataaaaaggctgcagttaataccaacaaacaaatattatttgtaacatgagctcttgagattatggtagaaatgtcacagtctgtatttgcatttgattataggagctacctttatttataaagaagcatgctgtagtgagaattctttgctaggagtcagaattgggttcaagttactattgaccacacttccagtatgacctcaaagccattaattaacatttctcggctcatttttttttctgttaagatgttgaaataacacctacttcacaggcttaatttaagaatgaaatgtgataatatatacaaaacacttagcatagtgatccattatgatctctgttattactatcaataatttggaaaaaatagatacctacttttaagaaataccttcatttttgttttttattagccatgtaaataaaactatcaggtattaaatattacatactgacatatattgaacatatatgtctgttttaatacatatatatttctttaatatatatgtgtatatatatagttctttgtttatttttagtactgatgattctattataaaagttgtagacatttcatttacaagtcattttagacctttaaaagaatattttttaagaatgtgtaaaagccagactttctttgactagatgacttttattctagaactgatttttgttttatgtcagactcaggacacatttgatttatccttaggttgttttctgaggctttaaagtatcagagctgagtggaaaaatacttcttggaaaactgattttccaactaagaaactcagagtgatggattgctagaataatggctgtaatatatactgagaatacaaaggagatatgtagtctcttcaagatgaatttgggttcataagaagtgagtctgtgttttattatctttctgcatataagaaaactcagactatatcatttctgcacaaattcatggtagcccctgtctagcctatccagttttaatatggaacaataaataatataaagaatatcatggtaataagttttttgtgttctctaatccagaaaggcattgttgccataacaagttttgtaattattggagaaaagtacaaggatttctcaaaaatcatttaaatggtaacatttaaatgttaagcactgctaagatgaacctaaaacaaatatttaaatatctctattgttaatggttattttaaaaaaatttctcatccacactactggtgcttatagatactatagccacaaaataggtaatactaccattatgctaatctctttgaatacattagtttattgaatattttttatcttttacaattatttcctacatctagcaaagatgtctagattctagctgtagcctcttgcctctttctccattcctgggtcttacttatatacaatttctcttcccatggccctcagaaatttttttttagacccctgcatgttcttactttctggctgcatctgctcttatatctttttttaaataaggtgcctttggaccctaccatggtatcatggtcatcgcctctcaaaaaaaaaatctgcatttgatgtctttgacaatagaagaatgattgtatgaaatgaatatccaatttatttttctttttttcattttcctttttatttatttatttttattttttagagatggggtcttgctatgttgacaaggctggtctcaaactcctggcctcaagtgatcctcccatttcagcctcccaaagtgctgggattccagatttgatccaccatgccccacccaatttatttctcatgattccaaagtttatgcatagatgctttagctgaacaatagttccttctaattgaaaagaaagcctctaactcagctgacatggaacagtctcctgcatgtagtgaacttactcactacagagggattgatgctttcagagaatgacttaaactatgacatgctgtgatgagtatatcctcaagctactacgacatgtttattaacctctgttacccaattaggtgcaacattgatcagaacctgacttcaatagttttgatacttagtcttttagctctgactgctttagagtataaggtccttgaagataggattaccaccttataaaacagagttgcacaacatagcatgttagaaataggttggggccaggcgcgatggcccacacctgtaatcccagcactttgggaggccgaggcaggtggatcacaaggtcaggagatcaagaccatgctggccaacatggtgaaactctgtctctactaaaatacaaaaagattagccaggcacggtggtgggcgcctgtagtcccagctactcgggaggttgaggcaggagagtcgcttgaacccgggaggcagaggttgcagtgagccgagatcatgccattgcactccagtctggtgacagagtgagactgtgtctcaaaaaaaaaaaaatagattggaacttttagtcatattcgttcagcttgaattctagttcactagttgtttgcttttgggcaattcatttaactgctattagactagccaactagggacagtttttgttccttaagtttccaaatggttgagaggctcaaatgagaaaatagtgccaatacagttcattaattttatgattgtttctggcatagaaggaaatgaaatatttaataaataaacctatgagtgaattgatgaattaatgagtggtattcaaattatacttttaaatgtatgtttaaatacatgtggcatcccatttcctaggcctaaatataatgaacatgcttgcttgcaaaaggagccttttgctaacttcccagagagtctcatacaatcagtcagagacaaagacccggtagccgcttcaggagcctcgcatagcaagtgattcctgttgttccactttgtgcttaaagcatgagaagttgggccagagtagaattggaaatggaggacctgtaggccaggctttgcttttaggggacttgtgattggcaattcgttgcagataataatgagaagaaggcagaagattttaatgaggcacgcatgtgagaacctcagagactctgggtaacttcggtgtctgcaaagtggctactccctgtttctcaagataagaggggaaggtttttccatttcaaactggttgggctcattttggtcaggaagagtcttggatggagaaaaaattccagccctgaggaaaaggcattcagcagtccctggtagtaaggtaagggttggtagcttaatcaactataggccacacagaacaacaacaaaaaaggggctttagcggtatgtttttacctagtaaaagaaataatttcacttctcctctctaccactctctttaaaaactcatcctcacaggtgtatgtaagacaatctgagagtggaggccagtgttttgcagtgcaaatccggcagtatggcttgctttgagaagtctatggcaatgctccaagggaaaagactgcaaaagtcaaaatataaatatattcagtgacttcagatcccattgtttccaggtcccttttgctttttccaattacctgtctcatttttgaggaaactttgcagtgcttttccttttattgtcattcttccccccaccctgtggtttttctaacacctgcactgcatcatccttcaagacccttttggctttgtttctgtgcatgattatctccccttctccctccttaccatatgcgttttaacaaaaccaattttcagtattgagttgaaaaaccctaatttaaagaagtaaaagagatcttcccaaattttaagcaaccgtaaagaaccagctggaaatgtatacatgtgtgtatgtttgcatgtgggggagcagtgaggatgatctctagagatagattagatataggaaggatttggcaatatacatgaggttagcgtgagaggaaggtaagtttaaatttacagtagatagccatttccaaggatgtattagaacaaatgcagaatttcagaggaaagaacagataattatttcacggcccttgaaactccttgcacatttctagcttgtaaagagaatgcagattagctttttatccatacagtaccttcatctatcaaatatttctgtctttataaacctacaaattacatacatacaggtctgggcttctgggtgaattagaagcaggggcaggtttcctcataaaacctaactttgtcaccaatttcatgtaatttgctactaaactgtgcttcttttgctttttatctctcttcttatgtgctcttaaaagctacttgctggccgggagcagttgctcatgcctgtaatcccagcactttgggaggccgaggcgggtggatcacgaggtcattagatggagaccatcctggccaacatggtgaaaccccgtctctacgaaaaacacaaaaattagctgggcatggtggcatgtgcctgtagtcctagctactagggaggccgaggcaggagaattgcttgaaccagggagtcggtggttgcagtgagccgagatcgcgccattgcactccagcctggtgacagggcgagactccctctcaaaaaaaaaaaaaaaagctaacttgctttaatctatgaccgtgaccttacaatgtactttataatgcatgtaccttgatgataacatgtgatttgtgatctttctaggctgacaaatgaatctcctagagctctgctgtgttgctacagtggtctgagtcattgtgattagaaattatttaaattcatcatttttatagacaggcctgaacaacctagcagagtttttttaaaaaaattttactcaaaattaaatatcttattttgaaaactgtccttgtactataatagctagcagacgcttcaaatatttctctttcatgtagacaaatctatacatttctcctcagagaatatagatgtcaatgcctgcagataagcaatccaaataagtttaatggaaggcagttttatgtaattaagttgtgacacttttctgtgtggaggaaggcttaaaaggaaggaaaacaagccacaaatgggagaagggcaatatgcacacgaaggttgtgcctgtggaattgaacattccttatctatcctttggttcttcaaatagttcatatctcttggacacatgacattgagaagtctggtaaaaaagataaagcctgccatagagtagcaagagaaccaagcaaatgtaatgtcacagaagccaagaggagacaatttcaccatggagggatagaaggatggagtgattgtctatatcaaattatgcttagaaaaaagataagaacaggtaagtgaccctttgctttgtgaaatactgtctctggtgactttgataagagcccttttattggagtggtgagtatgaaagtccagttgaaaatgatgagaagaggccgggcactgttgctcactcctgtaatcccagcactttgggaggccaaggcaggcggatcacctaaggtcaggagttcaagaccagtctggccaacatggccaaatcctgtctctactaaaaatataaaaattagctgggcatggtggcgcacacctgtaatcccagctgctcgggagcctgaggcaggagaattgcttgaacacaggaggtggaggttgcagtgagccgagatcataccactgcaccccagcctgggcaacaaagggagactccatctcaaaaaagaaaaaaaagaagaaagaaaatgatgagaagaagaaaactgaaggtcagtaggtatggcagtgagtataatcaaattagtcagggatttttttctgagaataattgagaactaaaatagtggctacagaaggagacaaggccagttatacatatgggaggacaaaagtgaatatgtgggcttcaaaaggaatacacatttatttttcattttaatattagaaaaataggtagagataaatgcaagttggtggaacttgtggtggaaaggtgaggctcttttcttagtcatggatgcagctacgtcattagcagagaggagaccaaatagcagctggagatttgaagaggggatgagtgatggaattgtcatctcagagagttttaacgttcaaaccaagtataaagtacattaggtacaaaggcagtagacataaatttgtaaataagaatacttagagactataaagaactaatcaggccgggcgccggggctcacgcctgtaatctcagcactttgggagaccgaggcaagtgtatcattgagttcaggagtttgagaccaacctagccaacatggtgaaaccccgtctctattaaaaatacaaaaaatagtcgggcgtggtggtgttgcacgcctgtaatcccagctacttgggaggctgaggcatgagaatcacttgaacccaggaggtggaggttgcagtgagatgagatcatgccactgaactccagcctcggcttcagggagagattgtctcaaaacaaaacaaaacaaatcaaaataaagtgaaacaaaacaaaagaatgaatcaatccaaaccagaaatgacatggaaagtagtggtattagaatgatattaagcatcagttccttttaaatgtagaactaaaatatctcagagctgtccaatgtaatatgaaaatgctctctgcattctctacttataatacttaaaaaaatagtgatattcaggtgtcctctgatgattaccatatttctgtttacatgatctaattgattgttaagcatctagtataaatttgttgaaatttttgacttgtggatggcatacttcccttattcccagcacagatagagggcttgtcttatttttaagtgcctttgcctgtttcaatagctgtaagtatcagggggaaatgaacacagctagaaatctgcactcaagtgttcatcctgccagtagttgtcatttaaatcaatgattagattttatcttattgacgacacatattaacatgtataaattctgaaaaaaaatgtaataattacaatttccttaccctatttcaaacagctgaattgttttaatatactattatagtcctttttttggaatatattgtattgtatagttagacaaatttgaattataaataaaccagtatcttatttatttatttgctattttttgagacggagtctcgctctgtcaccctggctggagtacaatggtgcgatctcagcgcattgcaacccctgcctcccaggttcaagtgattctcctgcttagcctcccaagtagctgagattacaggcatgcaccaccacactgggctaatttttgtatttttagtagagatggggtttcaccatgttggccaggctggtctcgaactcctgacctcgtgatcctttcaccttagcctcccaaagtgctggaattacaggcctgagccactgtgcctggccatatctcatttatttttattttttttaatttttattttagatttatggggtacgtgtgcaggtttatcacaagagtataattgtgtgacactgaggtttgagcttctactgatcccatcaccaatatagtgaacatagaacccaataggaagtttttcagccgttaccccacatctgcctcccaccccttttggagtctccagtgtctgttgttcccatctttatgtccatgtgtacccaaagtttagctcacccttataaacaagaacacacactatttggttttctgtttctatgtcagttcacttaggacaataaccttcagctgcatccatgttgctgcaaaagatatgattttattcttttttatggctgtgtagtgttccatggtacatatgtaccacattgttttcattcaacccaccattgatgggcacctaggttgattgtatgactttgctattgtgaatagtactgtgatgaatatgctagtgctgatatctttttggtaaaatgatttagttaacattgtgtcatcagtattctgagtttgttcatacacttagtaatcactactgatatttgtaatgttgaatataggtttccaatttgtggctatcacaaaaattccaaaatgaatgttttcaggcaaataactttttcatgttggcattgttctttggttagatttttcttttcagaattgggagtactgaatcaaatggcatgactattgtcatgcttttaatgtattttttcaaagtgttctccaaaagctttgccatcttacctctactggcaatctattagaatcttaattttattatatcaatatcagaattggacatttggatgtatctgttggatatacaaggtattcatttcatctttgtccttaatttctcggtggaccttcccactgtctgctactgtaagaaatgcattttttaaagtatggtagatagagtgtggtggctcacacatgtaatcctagcactttgggaggtcgaggcggaaggatcacttgaagtcaggagtttcagaccagcctgggcaacacagtaagacaaccatctctgctaaaaaaaaaaattatttatatatatataactatatatacaaatatatatatataactatatatatataaaactatatatatatagttaactaggcttggtggtgcatgcctatagtcctaactattctaggagcaaagatgggagggttgctcaaatccaggagttggaagctgcagtgagctatgatcatgccactgcactccagtatgggtgacagagtgaagccctgtctctaaaaaataaataaacaataaaaaataaagtggtttgaacttagtatatgcaattctttttaggcattttgttattaaccaaggattaaatgtctagtccacagtcgactatccgttttttgaaattttcccattaatatgtttcttctctggcctactgggtttgcaaagagatttgtggtaatgattctatgcctgcattcttgatatcatgttctgtatcccatgcttgtttaatattcttactggaggtcaaggaatagcataaatttcttatcacatcacagtataatgctgttaatttcagggaagatgtaacatactaactgttaaagaatgatcctctacttatagtatgagtggaaattcttatacatagattatatttattaaattattatattattttcaatatactcttagctttgaagataagtaaaactcaattaagacctagactccaccacttcctagcttaaatagatatttgtaaaattatccaagccaggaaaaatgaaaatatgaaaatgtatgaaatacaaaatctatgtccacctaatatgtttttttgagaattgaatgagatcatatatgaagacccaagcgcagttcctggacacaataagtgctcaataactattagttatctggctctccattctcttgataagaaatggacaaggccattctcatatcacaattctgggatacacatgagtgaaatcctgcatcttgtcagccaacacaccttggccatttgttactggaggaggcctttggaatgacaggagggcataagagtttgacaatggttctgcaatgcttgcctaaggagacaatgagactcaaccaattccagtttgcatgtggcaaaataagttaaaaagttgaaaatttgagttgatgaataagaagtagaagggcagtcagtctaacaaattggtaaatgtaactagccctttgggtctaatgttggaatctggtacttggaagatgtgttattgttttgttatttgtatgtacattattgttcttccctgattcagtaaattctgtactagctatggtaagtgaaacagagggaaagcattggtgcaattttgccttcatgggaattagcctacttttggaggctagcttgaggtgtcattgggaatgtggctgctagagccccactctcgggaggcaaaatcagtcacatttatgtaactgaccccaaatcaaaaacagttactccctcttttttattcaaaccatattgtatcatgagtaaggttgcttctgtacatgtcctagaaagatactcctcatttgtatagtcacaaaggcaagagtctcaaaactggtcatctttgaatatcacttaagctttcttttatggactaggaaacaattgagcggaaacatgtggtcaactctaactgtagtgcagtcagaaatcccagtgtccacatttcctgcagggtctgccctagtactttccttttacttatgaccacccacagtttcacctttgaaagccaatgtttggtgtgcaagcgtaagcttaagagaaagaaaaagttgatgctataataaatttatttctgaaaaaaaaagtctcaggtgaagttatttttagataatatatttacttgttattcatgtgaactgtgttaaaaagttgcttttatgtaggattaatttaaatagaatacttggataaaatagataaaaataaaggcaaaaaacttgtcttttctctatacacatggcattggatttcatacaaatgttatgtttgaaatgaaagaatatatttaaaaaataatagcctttttaaagcaattttaggtgtatggaaaaactgaatggaaaacataaagagttttcatatgacccttaactgcctatcggttttccctaacattaacaacttgtattagtgtggtgtatttgttataattgatgggccaatataaaaacactatttttacctaaaggccatagtttatgttaaagttaattatttgtggcatacattctatgagttttgacaagtgcataatggcatgtgtccaatcatacagactaattttactgcctccaaaatcccttttgttccacctattcatccctctctccttccccctgaacccttggcaaactgatatttttactatctacatagttttggttttttccagaatgtcatacagttggaatcatataatatgtagccttttcacactggtctctttcaccttgcaatatgtgtttaaagtttctctatattttttcatggcttgacagcttatttctctgaataatattccgtcgcataaatgtgccacagtttgcttatccattcacatattgaaggccattttggttgctgtcacattttggcaattacaaatacagctgttatacacatttgtgtacaggttttgtgtagacaatttcaaactcatgtttgtaattaccaacgagtgcaatgtttggatcacactgacactatttgacttgaggacatgctatgaagctgcaataatcaagacagtgtggtactggagaaataagagacaaatagatcaataaaacaaaatagagaaccaagaaatagaccacaaaactatagtcaactgatgtttgacaaaagagcaaacacaattcaatggagaaattatagtcttttcaaaaaatggtgctgaaacaactgaacttaaacaggcaaatttctttttcttttttaattttcttttttccatgagctagtgcagatggcattgttttaatttcaaatccctattgtttattgctggtgtataagaaagcaattatctttcgtatattaactttgtgtcctgtaactttgccatagttgcccaattcacaaatagttctttactgaatcatgtcatctacaaacacaggtttttctcctcaatgtgtttacctttcttttctttctttttttcttgtgtcagtggattaactaggaccagtacattgtggagtaggagtggtgaaagcatacattcttactttgtttctgatcttagtgagaaaacatgtaatttctcatcattaagtatgttgttagctataggatttttttgtagatattctttaccagtttgagaaagtgtacctctagtaaaagtttttgaggttttatcatgaaatggtatgataaatattgttatcatatccattcatgatgttgaatagtgttaaatgctttttactgcttttactgcattatgatataatcataagattttttcctttaacccattgatatgatagattacattaacagattttcaaatgttgaactagtctcacataccagcaacaaataccacttgtttgcggtatagaattcttttactacatcagtgggttcaatttgctaatatttttgataatttttatatatttgtaagaaatattagttcatagctttcctttttcataatgtctttattgtgttttgatattagggtaatgctagtctcacagaatgagtgagaaagtattccttttgcttctactttttgaaaaatattatagagaatttatgagaatttatatttcttaaactagtatttctttaattggtattgcttccttaaatgtttagtaaagttcaccagtgaatccatctgagctggttgctttctgcttcagatggtattaattattgattaaattcctttaatagatataggcccatacagattacctatttctccttctgtgagttttgacatagaaattttcacaatactcatttattatctttctaatatacatgggattataatcatgacctctctttcatttctaataatagttgtctttctttttcttagttaaattagctaataatttatcacttttatgaggtttttcaaagaatcagattttctctgttgatttcccattgtcactttcatcaacttctgctctaattttgtatatgtcttttcttcagcttactttaaaattaatatgctcttcttttcttagtttcctaaggcatgatcttagactattggttttagatttccttttattctactatacacatcaaatgctataaatttactgctaggcactgcctttgctgaatcttataaattttgataaggtgaatttttgtttagttcaaaatattttaaaatttcttttgagacttcttctttgactcacgtgttatttagaagtgtggtatataatcttcaagtgttttgggttttccagttatctttactgattttcaatttaatttcattgtgatctgagagaatacttcacatgatttctgttcttttaaatgtgttaaggtgtgttttatgatccagaaagtgatttatcttggtgaatattctgtgctgtcttgagaatatgtattctgatgtgattgaatgaagcattctgtagatgacaattagatctagttgattgatgttgctgttcatttaaactatgttcttactgattccctactgaaaacaccagcacaaggttaacaagaattacaagcctgactttaggaaaaattagagtcaggcattggacagggtgtgctggtacactttgacccacttccctgcagctgctgcataacccagagtcacatagcacactaaccacctgctccttcattgttcctatagatagaatctctgacaccgaacatttttacccaaaaattgctaaaggtgttcttcatatcctgaatttcagcagaacagcagacaccaagcaatctgaaaacccccaccaaggaagtgactcagcaccaaaacgttgtttcttcatctccctgtcctgtgacttcattcctcacttcttgaccaatcagcaatcccacactttggcccatcacccatctaggccccttaaaaaacccatccccaaacctcttggggaggcagatttgaggttccctcctgtctccttgtttgactgtcctacaattattaaacgctttctctgctgcaactcccactgtttcagtgtattggtcagttactgtgcaatgagaaatcaaatctggaggtcctgtaacactatctgccatatctatcaataactgttagaggagtattgaaatcttcaactataatagtggattgatacatatttttatagtaattatattagtttttgccttatatattttgacactgttgttgggtgcacacactctaaggaatatatgtcttctcagagactttaccccttcttcattatgtaatgctcctctttatcactgataattctctttgctctgaagttgccttgattggaaattaatatagctgctccaggttgcttttgattagaattagcatggtacatttttctccattcttttacttttactctatctgtgtccttattaagtggacttcttatagacaatgtataattaggccttttttccccactctgacaatcttagtattttaattgatgtatcaaacctttgatatttaaatgatgatatagttggattaatatctaccatatttgttactgttttctatccattgctcttgttctctttttttcttctttctttctttttctgccttctctggttttaactgagctcataatagagttcattttcttcctcctctcttagcatattaattatacttcttttttcctgttttctgtagtagttgccctggagtttgcaatatacatttataaacaatccaagtcctatttaatataaaacaataatatttttttgtattgcaagtactttataacagagaagtcccagtccctcccttctagcccttataacattatgttcattcatttcacttttccatgagttacaatgaccaaatactttgccattattatcttgacaaactttaacctgacagatcaataagaaaaaggaaagattttatctttatgtattccttttctaatgctcttcccttctttttatagatctcagtttctgacttataccatgtaagtttcttgcaaggcaggtctactattaatagcaaaaaatttcttcagtttttgtttgtctaagaaagtcttaacttttgaagacttccattctgaataacaatgtcattggatacagattttagcttggtgggttttttgtttcagcactttaaattctttcctgcacagcttctgttgaatgtagaagagaaatttaatgtagtacttatctttgcttctttttatgtaaggtgtatcttgcttttttcaagatttttctctttgtgtttaacctcctgtggtttgaacttgatatgctcccgtgtagacgtctgtgtctttctttatttttatctttcttgatgttccctgggctttctggatctttgattttgtttctattaatacttctggaaaattcttgattattattgttttaaatatttccttggttttgcctctcctgctatacgaaatccctattgttgtggtggtaaattgtttggggagggaaaagttaggtttataaccctatggttagttaccattcttaaagtgagactgtgtctctgggctgtcacttctacaatttgttctcaacccctcttcccttttaggtgataaaagaaggctggagggagctggagttgggtattgcccttcctccaggtcagttaggctctggtaaaatagtttgtcttaagggtacgccttgttaagcataacagaaagctctgtgtatttcaaatggctacttcccctgccccctgactcacacacacaattagaagcaccaacatatttttctttaaaaaaaatgtatcacccctccccctcaggactgggcctccctggtgtttttaactctcaagcttgtccatactgagccttgaataatttgtcaattacagtttaaatgttcctaccctgatagccctcttgattttaatttaaaaagaagaaaagtactgtacatcattatataataatgtctcccttctttctatgaagagatctcataatcctttttttactaacactttaccatatgtgattgacaaatttatgacgttagaaaaggaagacaactttgaatgtatgcaaagaaagatttggagaatcaaagtaacatattcaaaagcatcactaataagctttgttagttccttggcttttgtttgtaataattttgtatttaattagaaaataacgtgattctatccttgataattgagtaaagagccattcaaagagtgccaatctatggaccaggttttgattagcactgatttggtatgtagctttattgaacttagcaactcttctaggcaagttcaaggggcctgcttacctctgtctgtctttcaggactacaatctattcagaggaaaatctcaccttttctattttacaattgctgaagtgtcattttctgtatcagagtaatggtgctaatcaattgagaagatcacaaaactttggattcaaacattaacaagttatattgtgccaacagattatattttccaaaaaaaaaaaagagagagagaaaattggaaaaaaaaatagttggaaaacatgtgttaaacctcataatcaatctggtaatagaattttcatgattgtaccaaaccttatttcaatgaaaagccaatgtaatgtaactacattaacattcaattattctttattcctcatcgtaaatttagaaaaggtcaaaagagtaaagaagaaagtaaaattaatgttatcccacaacccttgtatataatattagttttccatttatatcacaacaaattaccacaaatttagcaacttaaagtaaaacaaaattattgtctcatagacctttaggtcagaaatctgggtgtacttggctggtttgtctgcttagagtctaccaaggctgggcttttatctagaggatctggaggaaaagctgctcccaggctcactcagcttcctggcagattcacttcctgatggctgcagggctgaggtccctgtctccttgctggctgtcagccagaacctctctcaccccatcgagggcccctgtattccatgttatatcagcccctctgtctccaaaccagcaaccagggcttcaaaccctcctcacgcttcaatctcttctgcctccaatttcagtaaaagcgtagacttttaagtgacttgattgggacaagctggacaaactctctactttaggatcaattaattatatatgcagagaccctcttgccgtgtaaagcaatattcacaccggtttcagggattagagtgtggacctcttcaggggaaccattctgcctgttatcacattttaatgtccctcaattttaggatgtttaattcattaacatataattcctttaaaaataggaattatactggatatactggtttgtaattgactttttcatgaaacaatgactggcatcgctgcatattttaatataatgtgctcagtgttcattattgtccaagtgtcaagcccactgggatgctcttggctaagagtgaagaattccacataattttgtacccctaatacttaaagcacaaaaattcagaatgacttagcatcttaaaaaatctggaagatttagtgttggtcatacaaagtcacccttactcatttgtattcttcttactttcttgagaagagacaaagacctaaggtctcattccaggagttatgtatgactttgatctgaatgtcattcagggtatacatcttgagaaggaaaagattgagaagctttgctttactctaaactgagatatggtttttaatgactgtgttgtattcaattatgagaaaggacaaatattttaaccaaatctatattttggaaataattaataatatttggtaacaactcaatatttttttgaacatagatccttggataaggccaaaatataaatattttaatgattataaatatatactatgtagctgctatctagaatgaatattctactttaaattctcactgattttatacagaaacacctattttactctgtcatctccataataaatgatgaacatactttaactgtaacactggcagatgtcttttaaagatatttggtatcttaagtagttatttatccttagattgcaatgagttttcatcgaaactgaatttttcttcttttaaaattatttttttatttttcatttttattttatttatttattttattatactttaagttctagggtacaggtgcacaacatgcaggtttgttacataggtatacatgtgccctgttggtttgctgcacccatcaactcgtcatttacactaggtatttctcccagtgctatccctcccccagcccctccacccctggacaggccctggtgtgtgatgttccccaccctgtgtccatgtgttctcattgttcagttcccacctatgagtgagaatatgtggtgtttggttttccgtccttgtgatagtttgctgagaatgatggtttccagcttcatccatgtccctgcaaaggacatgaactcatccttttttatggctgcgtagtattccatggtgtatatgtgccacattttcttaatccagtctatcattgatggacatttgggttggttccaagtctttgctattgtgaatagtgccacaataaacatacatgtgcatgtgtctttatagtagcatgatttataatcctttggggatatacccagtaataggatcactgggtcaaatggtacttctagtcctagacccttgaggaatcaccacactgtcttccaccatggttgaactaatttacactcccatcaacagtgtgaaagcgttcatatttctccacatcctctccagcatctgttgtttctgactttttaacgatcaacattctaactggtgtgagatggtatctcattgtggttttgatttgcatttctctaatgaccagtgatgatgagctttttttcatgtgtctgttggctgcataaatgtcttcttctgagaagtgtctgttcatatcctttgcccactttttgatggggttgtttttttcttgtatatttgtttaaattctttgtagattctggatattagccctttgacaggtgagcagattgcaaaaattttctcccactctataggttgcctgttcactctaatgatagtttcttttgctctgcagaagcaaattcttaacgttgtatgtcttcctttcttccttccatcttgccttccttccctcattcattccttgatttcctcctcctcttttttttaattgcttttgtttaaaaacagcatagtactatggttacaaagtagatagcaagatccagtaaaaatcaatgtgatgttaaatttaaaataaatttgctattattctggatccccaaaataacaatattatatgtgactttataggaatataggaatgctttttgaattagcagaaaaacatatggcattaatgtgcaaggaagaattatgccacatactctaaaagttctcaaaattgatatccatgaatctttttatctgtgcagtttaaaatgaatgtctttttttcttttgaaaattattttactgagatatattgattttatttttgaagtactggagtttcccaggttcctttaaactttcttcttagatttgctacaagatttttacactgtcatatttttgtaatgtacacttgaaatacatatgcaatgttgttaagtctacatttcttgttttgagaatttgacattcaaaatatgtattagtgttctaaaatatgtttctgcctccaaagccactgcttagcatggctgggtgttacagaaaatgctgtgtggctgtgaagtatgaagcattactaatatctcttagaatataaaatgaatttgttttctaaagtcaatgtgattctaggtcctcagaatttttatatagctacttagatgacagagttgtagttaatagtttgagaagtaggttttaatatctgtggtattgacatagttgttactcagtagattacaaaaaagaaaaatcttgtatccaattagaaataaacattctgtaagaatataacttcccagttagtcttgggagatggcagttcaagaagtactttgtgaaatattctaaaggattaacatagttcatcattttatgcaatggcaatacatatattatacaatacattcctatttttactcatgtagttcttcatataatgcatctaatattttaagggcttatatctgtaatttgactaggtcatttgtttagttatatttgaattttcagacaatcattaaaaaattgtggaagggtcactgttttattctcttattattttaaaaaaaataattaattaattaattatttattttttccatccagagtaattttgttttaaagttgtaggatgataatatttttacatctgtcacataaaattaatatttttaagcaatgtcacattttgaattgtattacaagtcaagaaaagatgttattattttaacacatgatattttgatattatcccaaatagatacagttgtgatattttcatagtttaactataaacatattttaaagtgccatttatttttattttattttattttattattaatatactttaagttttagggtacatgtgcataatgtgcaggttagttacgtatgtatacatgtgccacgctggtgtgctgcacccattaactcgtcatttagcattaggtatatctcctaatgctatccctcccccctccccccaccccacaacagtccccagagtgtgatgttccctttcctgtgtccatgtgttctcattgtttatttatttatttttgagacagagtctcactctgttgcctaggctctagtgcagtggtataatcctggctcactgcaacctctgccttccgggttcaagcaattctgcctcagcctcccaagtagctgggcctacaggtgcccaacaccatgcctggctcatttatgtatttttagtagagaagaggtttcaccatgttggccaggctggtctcaaactcctgaccttgtgatccgcctgccttggcctcccaaagctctgggattataggcgtgagccattgtgcccacctggggcactgttactttaacaacagaccatgtggaccactttgttgagcactcatatttcatgggaggcaagtttgaaaatttttattttagtgcagatgtgtacagcagcattttccaatgagtttgacatggttatgctctgttcgaattatgtttgtttatttcacaaattacaggtgcagcagtataaatactagagctttatgccgctagctcagaattaatttttacaaattggaaaatgttaatacattgatttttaaaagttgaatttaacaagcatttatgagctctaattttgtgtattagaagaatcattaataaaataaccagtacttattgagcactaatatgtgcagtttaatgctttattaatgatttttttaacagtcaaggaaactgaaattaacaaaatataagtaacttgcatgaatttcagaagttttcaggtaatagaagcaagattcaaattcactttttactcagatctcacagtcttaacattattctactctactgctctagaaacacttgttttctcctgacccttttatcccattcttcacaaactgtcattctcaaatttcaatcttcatccaaaacccgtagaagggtttgttatataaaacacaggatattagactccagtcccaacagtttctgctagtagtttaggtgcatacctataatatatatttccaaaaaaaaaaacctaggtgatatcaatgcttcttatccggggaccatgctttcaagaccactgcctacagtttcccttatgtttattgataaaacgggtggtatccattgtttgagttctattactattctatacacctgttctagttaaacaagatttagacacctgtgagtccagatgtcactgatttgaagatgatattaaatattctagtaccttcttcaaatgcttgttaattacctatcacataaaagtcctaattgattaatttattactcattaactggcagagctgtttcagtcagtctagactagacatagtttgcgagtttagaaatgtattctggagaattgattgatatgttatctgattataaaaatagaaataaaagaagaggtctggctgccgagccatgtacatatctagtattccactgaagatgcatggaatataattgtatattcattataattgaattattgtatctattttttcattgttaatggtatattgtttctttattacttcacctataggctattggataaaaaatgtttactattgccctttttattttatactttgaggtaaagccatttctacaaataaacaatttcttgtagtgtcttaacatccccacgtggaatgttttttaaaaatcatgtagcttattctaaatctattctaggcaaatgttaaaatcattttagttagaaatagaatgggatcaggcttcagtagatgccattagaagtggtggtttgtactaggaaggattcttcacttctacatctgtttaataagtttcacactttaaaactcattttattatcacaactgaagaaagagatagtaaaaatgtggagggatctaataaaatctagccatataatatttggagagggagatgggaaagggaaggagagacaggtaagacgtaccattaaaacagacaagcacacgataattcatggatgctgattacctgaccttttcttgcagcagactactcctgtgagacaaaaaggctagtaagaatacctagaatgtactttagatattatttttgagcactaatatagttagcctcaatgataattgcttttaagcaggccacacatacgctacacacacagacaaacaaaacacacattcatccacagggatgactgccatgtgcaaacatacactgaaaaccttctccaaggcaatgtccttcaacatcttttaaaaatgcattttaattgccattgtaactggaaaccgtttgcactcaaaattaaaataatcttcttttgctattcaggatatcgattatgttatgtcctatcacttggatttaattagatgtattttttttccatgccgaaggaggtaaaaccttagatataaatactgaaaaacaagcaccaatatttcactcatccagaaagaagtggctttccacattattcgcttgtgtacaattcttttttcagtttttctatcttacattaaactcatttactcataacatatccaagctgaatgctgcttttggctagaggtaatggtgtaagcactttttcctgccttgttaatcccagccttccacatacaagaaactttatttgaaatctgatctcacactgaatattcttattcttatctcaggtgtcaacattatcccatgtcccatctcagagcatcacatcttacgtgatcatattgtgataaatcatagcgttctacagtatgttctttgtttttcttatagcattttattgttgtactgtatttgttaaaaactgtatcataatacgtaatgtctgacatcaagagatcatatctttcctgaactgtttgcttctatattctgtaccttatgtctctttctgtttccatcaatacctttcaggcataaggaaaagaaggacactgattttcaattaatagtctctggcccaaaccctctattaggtacaaatatattaaatagatcatttttctcaacctatgtcagtgtttcataaggcaggaattatttttactttgtatatggaaaaaaggaaaccctgagatgctaagtaaattctttggtttgttaaattgaatgtaaaacatatttctgggcatacgtattgggggattggatagtccttgttttttctgagtgcattggttgaggagaatcctttgccaatatagtaatgcacagaggctctgcctatgcaaccttgaagaccctccacatacatgcacacacacaccactcacacacacaccacacagacacacatacacatacacacacacaaacacaaacacacatcacacatatacacacaccacacacacacaccacacagacacacatacacatacacacacacaaacacaaacacacatcacacatatacacacaccacacacacgcacacatagacacacacacacacagacacacacacacacaccacacacatggcacacacagacacaaacaccacacacagacacacggccagccgaagtttggagaaggaggcagcatggagaaaaggggagtctgacaccagcgagtttgtgaggaaggggaaggccaaggacttctaggggcaccgggctctgacataaatgtctgttgggggtgaataaagtcctgctgtgtaaaataggctcctcttgaatgccctccatatgaagtcatcctatgaagtctaaaaagaaaatcacaaattgctaagaaagatgaagtttcttaggaaaaacaatgtcaaaatgagcaccttgtactgcctggcatgcagtcaggacgaagcagtgggacgcagtctcttaagtgtggggccgtagtggaagccacggccagttggcatggaaatcacttcattctctgagccacacagaaagtatccccaggtcttcaattgtgttttgacagctacggagcagctgtctactccggcaaatgcgtctaatgtgctgtgaagattccttaattctgataattcactgctcttataaaaaagtcatgtaaaataaaatatcatttagggagagaatgtagcttctcatgaactctggtgaggacccatttcctggcctagaagttcacctgtgatctatgtcccctgcccacctgggctgttgggacttctgtgggtccactgcttacccagtgttttagacagatttcctccaaattgctccattttctctaacagccctagcattattgtgattaatttgactgcaattgagttttattacgagactgaaatttgtctttgactttggcagggaacttgcctctttgtcatcatcatttctagccagccagccggagctgtggtgccagacagtgcaagcgacaatcagcctacccagattgaaggtgtgtgtgtgtagggcctgcagagagggacagtgatgaggcagggagacgggggggaatttatgcggggagttggtccaatagtcattagaaaatagtcacaggaggacaatccaaagttgaatgaagtaagagcatcacttggtgactgacagttttaattaattcattaggaaagagtgtacctaaattatcttgtaccatacctgtctcacactgtctatcctgagtcaaaccaattaaacatttaaacataaaatagggtgatatttcattaagcataataacgtgcatttctcagctcaaaaatatgtcatatcaccaaacgttgcagaaaaatgagcaaatgaaataaatatggaatccacaatagaagaaaaattataaaaaatatataaaaacttccaattccaaactttacagaaattgttaaataaactatatttatattatgaaatgttaattattcattaaacccccattttctgaaaattatggtgtcataattatataatgatagtatgatattgagtatgaaaagtatgatattaaatgatataatgcaaattttgcaccctttttatggacgtgtttaaagtttgtagcagtgcaaaattttaacatatttctttctgaatggaggtaataggagtgatttttttttttatttaattttattttgctgtgatttctaccaggataaaggtgtaatcatgtatacttagaaaaaaaaatttaaattcttctgcaaatccaagaataagtggaggtttggcattaccattagagatttttatttttatctatcatgttgggccaaagtattactgccatttttttccatttatattttagtatagttccaatatttagaaactcctttaatgtaagttagagaaaattggacatataatatttaggaaaaagaaaatgcagtgtaaaaaataaagaataaaaaagttttctctagaaagcttgaaatctggcaccattatgtgaatatggggcaggggagcctttaataccagtgtgagctggagagcaggaggggtgagcacaaggcttgataaagaactaagactctaacccatacattctgcagcaagatttcttctgatctttatgttcctggggaccatggaaactagccaagggattggtatttctgcatgctaaagtgtagcctcatgcaaacctttaaaaagaaaaatacctgaggaaaaatgtgaaatttctcaatttcagatattcaagggcttcctgattggtctccctgagatcactcaccttttcttggatgatcaatattacaggataaattgtgtttcctaaaaatgtttacattgaagtcctaatctccagtgcatcataatgtgactttagttggagacatatgtttaaagcggtaataaggttaaggtgaggttatgagggtgagccctaatctaatatgactggtgtcctttaagaagtggagatgaggacacagacagacatagaggaaggatcgtgtgaagacacagggggaagacaaacatccacaagccaaggagaaaggccttagcagaaaccaatactgctgaccttagacttctagcctccaggaatgcaagtaaataaatttgtgctgcttaagccaaccaatcttggcagtttgttatggcatccctagcaaactaatgatgcaggagtttttcttaaccccttcatcggacttgtgacacggatgccccatttacttggcctgtcatgctcaacctcttgtacaaagaatgcactttgggcaccagcaagagcaggcttcatgtggaccctgaggcgatggtgcctaggtgggggtgcctgcggcccccaaagccccagagggcatattacaatgctctcttagctccaccgtctgtggacattgttatgttatcagctcagtgggcctcttgccttgtcgcgtggggctgctgctgtccaccagtgagggcaaaggactagtgtgacagccttttttgggtacctacacttggtgggtcctgagctcttgtccagcgtccaagaagaatgaggttgcacggacacttgaaggataatggaggtagataattttattcagcgaaggaaatggctctcggcagagaggggagctggagaggggatggggcaggcagataatcttccctgaagtctggccctctccggctggctcttccccaaagttaagccatctctcctctgaagcccagccatccctctgaagtcaagtcacttctctccagtcaagctgcttctctctctctaccaaatgagtctgggtctttatagggcacaggatgtggggcagaacaggctgtagatagttttggaaaaggcaacattctattggtaaaaagacgttattcaaaaagaaagaatcaggagagaatgggcaaacagggatagaagttctcactttgggccacaggtttcaggcttttgacttgatggtggggtttcaccagggactcacccacccctgtctgcccagaatttctgtttcctgcctctatcattaacacaaccaccaagccatcctattcacctctgccttataaaaatatgaaatactagctcttttcctgttctaaaagtgcttttgactggtctctgtggtctacagattaataataatctctatatgcttattagaattggcattatcaaggatattacatatatatccttatttagtatttataatatcttagtgagatagagattttaaatttcattttagagtaactgagcttaattaattgcccagtgtcactatgaacaagtctcccagtgttgagatgacactttcattttagtttttattattcaatgtgtaaattaaaagagttggagtcttgaaggtttgcggaacttgaagtattgtcttttcaaggttttcctattgtgctagttaaaatacttattgaccaggatgaagtcagacctgctgaagtttacatcaaggatggtggagagaaattaatttgtgggcctgtctcatcttctcctcaacaaaacccagtatgggggtcttggagacaaacagacctggggaaaattcctgctgtaacaactgaccaactctgccatctggcacaatttctcttagctgcagttttgaccctttaaactgagaataataactagtttatggaggtgtgatgaataaatgattggctgcatgcaaaacagcagagtgaagtagaataagcagtgcgtgttggctgttagtatcatctgatatcatgtggggatgatcaaaagacagagagcccactaaaaagtactttctcaatgtctataaaaggtaattgatttaacttgaaatagtttagactggggggagatagtaaaaatatcatttcatcttcctcatagacctgagctgaagctacccttactaacctgcttttgtgacggaatcaaagcttacttaattcccaaggtcaggcagctactaactggtacagtaaggtagccaactctggcaaccgagttctacattttcacagctacttcagtcaaatcctgattcaaggctgttaactttcacacttctcaagtgtctgtcttgtttcctcagaaccaagccagtggtagataacgtagaaaccatgtaataaccgtaattggcaaggcttcacttttcctacctcaagttacatgtcaccacaggatatgcaaggaaaaagagaattttccagttccttttcccatctgggtcagggaatggccaaaaaatgatcacagctgagaaatttatgtccatgtttaacatccttgcagagcctactttgcaaggaggtaagactacctgttgtcactggtattttcttttactaaaatataatttcacatttagaagctaataaggacctgaaaagttagctatgctatttatcataaaggtaatactatttttttgcagtgatggtgcttcctttcctgattttgaagtagattgtctctaagaagagaaatgatattcccctgaaaatcatatggccttcaggaggtgggggtgggaggtcatgaggttctttggatttgtgggaaagacgcaaagataatatatcaaagaagttaatgaaaatcatttacccagatgtgtttatcaaagatatagtgtttattcattacctctaccacacaccccatttcaaatcatttcttaaacctaaaaacagaaattatacacgcacagacggcctctaacttatgacggtttgacttaccatttgttgactttaagatggtgtgaaagcaatacacattcagtggaaaccatacttagaatttttaattttgatgttgtcccaggctgtcagtaagcagcaggatactctcatgatgctggcctgaagcagtgagccacagctcccagccagccaggcaatctcaagggtaaacaactgacactacactctacagtgtgttgccagtgtgtttgtgttatgtatttctgcaacccatcatgtctataaaacatccatctgtggcagtactcaacacattattataaaacaagcttcgcattagatgatttcgcccaactataggcaagtggaagtgttctgagcatgtttgaagtagactagcctaaactgtgatgagccataggttaagtgtattaaatgcattttcagtgtgtgctattttcaattttggatgggtttttttttttcaggacataaccccattgtaagttaaggagcatttgtattatttttctagcccatcatctctgccagatattttttaatctttgagattcccaattttatttgactatttcacccagggtaccactaatcacaatggcaatgccaactgaattcaggcattctattgtttctctttgctctcttttagcaattaaagaaggatataaaacttgatactttgggacacttcgttttaaacttcgggagtaggacttaaggattctgaagctgaggtggtaacagctatatatcctgccagaattggtctctgagccccagcctgcttctccatcaagtcataaaagtgtgcgttctgtgtactattgcctttaagggtctgtctgaactacttctcccagaactacttagttcatttatctcttctccagtgtggactctgaatcagatttgctctctgccttgttcccaggattttcagatttttacttgcttctcatttattcatccatcccacactttggcattttctatgtgccaggcattatgatggacttcagggatagttacatggctcaacaagatagacatggacccagtcttcctagagttttcagccaaattgtagtacctgtgagacagaaaagcctagcacctcttgcaaggcaggaagcaaagtagaggagacagaaatgtgcaatgtaaagccttttccttccaaaataaggagtggaatttgaaaataattatgacatttatttttaaatatatagtccctacccagtgttctgggatatatctttgacatgggcaaaaacaaaaacctcagcttcagccaaaacaactcattctatgcccctagtctagattattgcattttcttaccccaaatttacatacaattcttcttccagagacatgtatgatagggaagggaccccagaatgcttcctgttgccagatcaacactttcaaactcctccttgccctcctctgaattcttctagcgtaactgccatagaaagcatgctaaatattattgctttgagacagaaaaacttggcatttaattttaacttcaccactctacttaatacctctgggtttaattttgccatatgaaaggccaatctagataagtggcacacgtttactgcattattgtaaaatttaaatgagataatattcataaaagccctccagcagttaatatgtgtattatttctttgcttagtatgacttgaaaatagtgaaatctgtacattttattaaaaacaacaagaaaaaattccctgctttcataacttgccagttttattgacttgctgtgtaactcatggttgaaacaatgcagatttatatttaaggtagaaattctcttttgctcatttcaacctaattacaccaaattttgccttccttcctttttcccccaccttaaccattctcctttttcccttgtggcaaaatctaatgattcctatctttaatcatgagcaattaagtcacagtggaatatctctttgcctctggaatgcatggtaacctcatactctgacttatgaaactggaaacgtaaattacagcataaaatatttatcaattaaaattgtgttaatttttttaaatccaggtaatttttaacaacttttattccaggaaattataagtctatatttgctatggtttctaccattaaatatatgtatacacatatgcatacatatatatatatactatatacatatataatatttaatataagtttaattttacaatgaacccaatgtaccaggttggtgctttttaatgagaaatatatgtaatagaatgtttaataaatccatgaaatattaaacctaacttagtacttgggaatcttaaatccctcattaattttaagaaaggatgataaatataaatatatatatatattttatatatatatatatataaaatgtgcttttagtgatgcattatttgagccttaatacatttaaaagaatggctagaccagtgagcctaaaggacgttaaagatctttcctattctggatagaacagaagtgaagctgatgcatttttcagtgtctgttatctaccagatactgtgctagtggcttcataatcttggtctcctctaatcttccagcaaccccattttaaaatgccaaaatagccacttaaggataaggacagcagcatctctcaaggctaacttcctctctcatacctagtaagtggaaaaacagaggcttgtatgatatttaaacatagcctatgcacttttctatttcctacactgcttttagttagaaaagaaaaaaaaatgatcacaaatcactggtaaacatctgcaacatagaataatgcttctattatccagaatttaattaaatacacagatactttttttagtaccaagttggtttatgttagagtgtaactaatatgctcttcatagaaatgcagaaagacaagtggttaaaactatttgtgtaaaacatgatattatagccttggaagtgagaatcaggtatgaagcaatccttcttaatgtagggcccagctttgcttggccactttagagatggagtgtttcagtccttgtccttgttttccatctgtctggtctttggaaagcagaacagatgtaaatggtagagttctgagccattcaattagatttcatgcaccactgacccaaacatttctcctcaatcttatctgagttggtggcagatgtgcagcatgtcagaaagcattttcaaattaaagatggaaacatattgtatgttggttgatatggtcacaatatgtgtaagtggtaaaatatgtcaccactagagcaacaactatgatgcaagaaggaacaggaaaaatgggcatttcacatttcctttccttattatcagaagacaagaaagtataatttgtcaaatgtgcattggaaatcatgggcttcctgatatgtaataaagaccaatgtaaggctaattggattggactctgcattctgccatttacagggcttaatcaaggcatcttggtaatagagctgagtctgtgatgatttatgtagatagggctttgccatcactgaagatgatgagacttacactcagggaccctcatcattacccattcactcagcctcacaatccatggctgactcaaatcatgttgtgaatcagctaattaacaatgagatccttgcacttttatagatgatcaattaatacttgtcaatttattaagtttgcttgatgggctttagcaggtttcttgttgaggttatgagaacaatgatggcatagaagagagaaagaagcaaatatatatgtagataacctaccggctgtatggaccctgggcttaatggagatctcagtacaccctggggaaaggtgaggcccaataaaggcttccatactgaccatgaagagtgttttgaacctgatccaggatctgaagttctgaaatcacccacatattgtgtcattatcaatgagagtatacaaagaacagtcaaaaggaaataaacccatgcacaggtgttacctaaaggatttcttctcttgggggtaagtgtgaattcacttgagtagagagcattacctttaaaaattatagattaaaagaattacaagggatattacaactaattttttcttctttccattgagtgtttgggacccatttccacaccctgcaacatacacacagaataacttttaggtccatttattcccaaaatattgaatttgatgtcctctaattcctgactcatgacagtcaagagcagaggcccgtacaaaccaatttcttggtacctctcttcttcctggttctgccaatactgagtttcctctatcagactcacagttgacctgttaacataggtcatgctagtttcctgtaatattttcctcctgctcaaatctggtactttccacacatttatttttctattatcagctaccttgagaaagacaggagatcatatatttagctatttagctatttttttttttaccatattgatgttcattgtagtttaaataactctacagtggttgcattttaataaggctgctcctgacaacagtcctgaccgattttggaaagataccaaaaataaaaataaggatctccagaagtcctgtggactctgtcgttggagctggagtgtgcctccatccgtagacttcctgccatggtttccttccagcacattttcttcagggcatggaggctgaaaatgcctgacttctccatttaaatcactttaagcaaaacacagattatttaagcatatcttttgcatcctccatgcccagtagtaattttgcaaaattactgggaatctatttcagggcaaacttggcatttaaattaggtggttttaattagcatcttgactgcatgcagtcaacagcatgaagagaaggacagggaaaaatcacatcagcttatatttttgctgtagaaaaaaataaataaaacaataatatgctgaaaaaataacctcaaataattcaaagcaagatggctggcaattttctggaattagaatgataaactttatcatatattgaaattgttatatactgcaagactccttttaattatctttaccagaattttcataaagtttacctttcttctacacaaagaggcccacagacagtgccattgcagttattctaacacaggtgccaaatggactctcacatacatcccttccccctccactgttaaatattacccatcattcaagccatgacttaaaaactcacttctaggttatataaaggtaaccttagccacaaatgtcatctctctgtagcttgagaactcccacaatattctcatacagtcatatggcaaaacaagaacaccaacaccattcattgtttaccagttctaggcagtacaatctcagtgcttttccggaattgcctcatttaaccttcacagcagccagatgaggtgtgtgctactatagtgtcccattttacaggtaaggaaacaaagacgctttacaaagtgtaagtgtcttgcccaaggtcacagctagtaaatgggagaattgggtttgaactcacagtctttgcaccacacactacattatattgtgaggtggagagagtctctcaatatcatggaatatgttttacatattttcatgtgatttgaattttaaagatagtgattggaagtgaactatgaataatttcattttatatatattttagttatcaaaacattgccgttaggctttttctgcagtaaatgattacattacaaagctgttcaggagacgttatttttttaatcattctctagcatatttttccttttgtccttttatactggtaagaacatccagattctcagatgggcttagctgcagccgtggagtataaacaggatggaaaaatagggtgttaaccattatttgagttggctctcaccatcccatggaactagaagcaatttagaaacaggtggccacagagtttgctcaagaaagtcctgccaaaccaagatagggactttactgacttcttcttactctgctgatgccactgtacagagctcagatgaaccttggttgttgactttactgcaagaaaaaaaaaagcggttccacatacacactctttcaacagcttgttgaattccaggcacactctgggaagcccttagaagtgatgacctcatgcagagaggaggctggaagctctgtcatttcaggaacagttacggaagtaggagtgcaattgaaactttggggactttatttaccactgtattcaatgacttcaacagcttcaatatggaaggaggatttaatttcttttgtgcaggataaacaagagaaagatctggctcaatattaagaagaatataaaatggtcacagagtgtattggaaaaagcacagaaatttattcagaacacttgattctgaactgagaccctggtcttgctgctgtcttcccataaggtttttctgcttagactttctgaaattcatttattcaaatgttaagtgagcatagtaatatctatcttttagatttggggaggataaaactactgaaagataaatcagttagcatgcatactaacattagggaggagcattcaagggatcagtacaggctgtgcaaccttttcccagtattgtcaaatgggaattcaaaaatccaataaacctgtaaaattgcttccaaaacagggactatgaaaaatgaaaatgtctaccattctccctgaagtccattaagggattcaaatacctataatgacttaaataagtttctttagtccggatttaggaaattgaaggttgaagtacaaaaaaagaaaaagaaaataagtaatgtatgcattttagtattatcttctggaaacaatttcttaacctgtgtgaattgcacaatccttgaacatgtggataccattctggtcggtaagcaagatgcagagtgctgtaggtgtgtacattcttaaatgaaacatacaccagtgagaagaatatacaggagagacagaagtatttctatccatggtagaactttctaagcaagttacccccaaatgagcatcctcctgaagtagtgagtttcctgccatggatgtatatgcttgagttaaaaattccttgagcaacccctgggtagggaggttacacagagctttcacatacagatgagagaattgaagtaaacatggattttgaagttcctttctaccatgattccattatacttcaggactttaaaatggggactagttgggatagatctgtgaagttaaaactgaaggaaccttcagatagtcttgacaataaggacagaagtcagaataaaatgatttcctcaagaatacctttgcctcctaaagtcagccttttttctcctctttgtgtatgaagagaaagggagtgaaaagcagatgtcccaatgaagatgtgattttgtatcattctggggaactgacaccaaagggaatccagggacccatggaccaggagccaggattcaccttcttccccagcaataaaaggggtgggagctgccagcaactaaatcgcagtttccagccagggagtatggtggcaaccatgctgcctaatacaaacaatgggtttgttccagtgcacacctcaagaaatgtatttaaattccaaatcccaaatgaattcggaataagaagaaaatgggaggcgccaaagagtaaaaagtcagagaaaagtaaataaagaggtaattttagagaagaacagcaatatgaaaatcttttcaagatagggttgtgtaaccaagcatttgtggacagggtgaggcaagatatatatggttttctttttttttttttttttcagataaaaatagcagtaactaattaagaaatcctggatcataaggaaaagtagaaagaagataagtcagttctagtcctagcacctaaacagagctactgtttatctttagataattcctttccaccagttattttcagtgtaagaattttaagttggcccggacgtggtggtgggcatctgtaatcccagctacttgggaggctgaggcaggagagtcacttgaacctgggaggcgaaggttgcagtgagctgagatcacgccactgcattccagcctggttgacaagagtgaaactctgtcaaaaaaaaaaaattaagttgaaatagttttaatggccaattttatatttaattttcatatgaatctagactatttctcttggttattataaacccttcaaaaatacaatttaatggctatgtaatattccttaaatagatacacattaacttattctatcttctgattgttggacaacaaggtttgctttcattgtttttactattcaaaagaggttttaattacatttttgttcacaaagactttttttctttaaattatactgctagcctgggattattgagtgtgaatataattaaagttttaatatacaatgttgcaataagttttccaagtgtcttcagatgagcaaaaacagtgtatgccttttatcacttctctgaggcagggttttggttgttactgtaaccttcttttcaggatgaggtctgggaattagtcattactctgtctgctgagaaaaagaacctatagcactttacagaaagctgctaattaatccttccaactctctagtgtgggaaggaggtagaaatgtctccactgcagtatttactaagaaatattgtaaatggatatgacagacaccaattcaaattccccggatgagggagagccgtcttgctagatgatcatgacttctgctaaaaacaacccccattgactccagaggtttcctagaagattctgggctgctgcatttgccatgcccatcgtctctatattttgaactcatgagaacccttgggtctagttcgggattccaccctcttccgaagagatacatacagtctgaaagtaatgataaaatttactaagtctttcaggcaatgtttaaaatttgtgcctacagtttccttcagcttttgtttccatttgactgtgggcatccccagatgccttcagccgtggttttttttttttttttcagtctttgtaatagctaacgctgacctccacgttggcactgaatttccttttttgatctcatgttctcataaggcaagatagccccatgcagcctctgatagggttcacgtgtctttgttagttttgtttttgtgatttttgtttgcttgcttttttatttgcaagtaattccacactgaaaatttaaaaataaaatttaaaaataacacccatggccaggtgtggtggctcacacctgtcatcccagcactttaagaggccgaggcaggcagatcacctgaggtcaggagttcaagaccagcccggccaacatggtgaaattccgtctctaccaaaaatacaaaaattagctgagtgtggtgccaggtgcctgtaatctcagctacttgggaggctgaggcagaagaatcacttgaacccgggagacagaggttgcactgggccgagatcacgccattgcacctccaacctgggcaacaagagcaaaaccctgtctcaaaaattaaaaaataaaaatgtaaaaaataacacccacatatccttttcccagactcagctattgataacattctaacccatttacttcatcattttccatctaccaagcgactgttcaatagctaacatttttttctgatccataaatggcctttgggcatatcgtatactctgggctactatttcatagacttgaagatatattctgcctgcatttagttacataagacatccaaatgctttctcccaggcccctgatattacttaaaggagtcagattttatagctctatgagctcccctttacctggagtgcttctttttatttctagccctttttttaattacactttcagctactgcaaatacttactcatgtttcaaggatcagctcaaatattcaattttagggactttctatgaacttttccctggcagaaatttcctttattacaactcattatcgtatttcattttctcctgtgtgtttttttctggtagttggtaatcttcgcaaaagagaaggactgtgtagtattatataattttccttggtatctagcaattagtttagtaaatgccatgttttaggtaccccaaaatacttgtgaatcatagtaatataaatcgtctgtctttgttcatttacgttattattaattattttgtttaatcttttagtttgcttttcctcttgatgattgacttggttcatttaataccccattaactcagctcttactctaagcaagctgctgtgatagttgctcaagtgggaagttacaacagttaagaatgcttttggctgcaacacaagaaaatctatagttaaggtatctggatataggtgatttagtctttgatgcagtggctcattgatatcatcaagttctcaggcttgtttgaccttttcactctgccattgacaggtttgttaactcatggtcacaggatagctactgtacctccaagcatcacattttcatctgactgtgtttaagcaagaaatgaagaggtctgggtaaatggagatttctttaaattggatgaaaattgttttccagaaatcgtccagaagacttttccttatagtgcatttgctagaactgggtcacatatatatgcttagtggcaagaggtgttgggaaagtaagtacctggcataggaaaatagaatttccaagactgttttaaaataatcattaatcatatctggattgggtccatcatcatcataaacaaagccaggtttctctgagcaaagaaggggagactaagttcttggatagaaatgtcaagttgtacgacacagtcacaaatcaatagatcatttcagaactcaatccaaaactcatatgttccaatagagttgggagggtgaaaaagcggacaagtgtaacgccattaatcatgatctggagggtgagaagagaggagacagatgccccagatagatataattagtattagtgcagtccaccaagggcttaaagtgtggcccaggagtcaagatgtccaagcatcaggagtgtgtcagcaggctgatgtttacaaaggttaggactttctaccagcttatttaaagtctgttccagcgagctctgtttccacgagacgttactagaaaaatggaggctgtagccaagtttgggagatgggctatttgacattaatgtaccaaaatgtacacattttaagcagaggttgtagtggtcagtgtttctgaagcttatttgaccatcaatttttttgtccacagaaaagccaaatacatttggtaagtgttgtgtgtccttaacagcgaaaagagaactggcaagaaaaaggtgaaaggccaatcagagaaaaagaacctgaattttcaggcagatttttaagaaagatattaaaacattgataaccaaagttcagtgatcagaacttgggcatatagagattatggttcataaaggacaacgggcccatgagatattagcagcatgggcctttgttgttggatcatctgaacactggactagaagaagtgttcaggtgaatcctctaaattgtagaagcaattttccaagaatgagccatgttcaaggtaaaagtggagttatttttttgaggggagggagcagtgcaatgcacagggtgtccagtcatgactggaagatcaattaaaagcagaatcatggagagtagaaaagggtgaagaagacacaaggcaaggcttgataatgtacatgtacacatgtgtttatgtatacagtacacagaagtatgtatgtatgcttgtattacacacacagaaagaaatcactagagtcccatattcattatttatgttgtgatcttcagaagtttagaggtaattaaaaatagcatgtctagtttcacaataatttgggagatgcacattttttaaaaactcaaattaaataagtttgttcaatatttttagagatctcatgaaatagacccagaagagagccaatgctttcctctctaatatgtaaacatatcttatttagagaaatatagttagaaagtctggcagaaatcagtccaatggtttttcctgaaagcaaagtcaactattgatacctagaaagttctttggggaaagtgtaaggaaccagtaagtgattaaagtacatatttgacacatgttattcaccacatcattaattactcacttttcctccatatgcaggtcagatgatggttggatagagtgttggattttataatgttacattgttataaattgtaggggtagaagacaagagaagccatcaggtgcacctttctataaatgtgggttgggatgaggaaaaaggaagacagttgtgaccaggttcattgggccttgagagagtgatggtatatgggttagcttgaactaatctagaaccttcttcttaacaattaacagaactagaaagaatacttatatcttttggatttataaaggcgatcataaaataacttaaaaatacttgaagaaaagacctgaacccaaatggcttcatatcaaactacaagcaattcttggttaggagaggctaatacagtgcatcaaacctaaaccactctgcagtcttttactaccaccttcgtttgatcttctttcatcttctttgtcccatgatttctattctatctcattctgcaggcatcagaacccacgtagttatttgaaaggttctctccccataatctaaagactccagcttgactaaagttctaaagctccaaagaccccaaattcaagagcttttatgcttctttagcttcttttcttatttttggattctgtaagaatacatgcccatgatggagttgctgggcaggctttccagtccccaagaagggacatattcctgtcttctgagggtgctgtaggtcttctgttgggctgggggaggattcatggtcttacttttggaggggaaaacgccccttcttatctgagctccattttttctcatagacaaaagggtttactgtcattattattattattgttatctgtcctcgacgtagcagaagctaaatacattttttggtttgaaacaacaggctagacatccatagtattacttgtagtgcaccaacataaacaataccaaactagaatgttctcttctcctttcccttttcttctcaaataatgcagtcctgaagacataatatgagacattgcaaaggctgtgttcaggatgattgttggtgctgggcagggaggctgcagtggactaggcttgggctttggagcccaagtgagaggaaaaagtaaaacgtttatgaagtaggaaggagattgcctggtgagtggtgtcagagttgaagtgggtatgggggtgtccatatgtagagtggcttcgtgcgtagtgtcaaagtccaagggaatcttcatggggaaaggagtagtagcaacaatggaagattggttatatgtagtaatattaatccataagtaaatatattaaaggcagtgagagccatgcttctctttggaggggaagaaaaattgcaaataagagaaagaaaactaggatgaacctttttgtatgagactggaattatagccattaatctgaactcatggttttcaatatgtgtgtctatctacatatgtgtgtgtgtgtgtgtctgtgtgtgtgtgtgtgtgtaaatatgtgtacaggcatgcggtgtgtgtgcattccttagttctgtcaggtgagagagcctgggattaatgacactccacatcttggcatctaaataccattcttctccaaaagaaaccagtttgtcctggagaaacattagtttgcaagaaaagtacaagacaagccaagcctggaatgtctttttgtaccagaaagcaaaggagttctcaaaaagaatgatgagatgttcacatataagtgagaccatataatatttttctttctgtatctggtttatttcacttagcataatgtactccagggttatccatgttgcagcaaatggcaggatttcctactatttaaaggctgaataatattcagtttctttatctatttgtcctccatggacactcaggttatttccatatcttggctattctaaataatgttgcaatgaacatgggcatggagatatctttatgaggtggtgattttattttctttgagtatatacccagaagaggaattgctgggtcatatggtaactctgtttttaatctcttgtgggctgtgtgtgtgtgtgtgtgtgagagagagagtgtgtgtgagagagtgtgtgtgtgtttgagatagagaataaaatagtggctaccagaggcaggattaagggtaggaaatggggagatgtaggtcaaaagatactaagtagcagatatgtaggatgaacaaatttaaagatacaaagtacaacatgaagactatagttaattatagtgtattgtattcaggatttttgctaaatgactagattgtaactgctcctgccacagaggaaaaatagataactatgtgagacgatttgtttcatgatagtaactgttatactgtatatgtgtagctgaaaacagcatatattatgccttaagtatacacaataaaatttatttttttaaatgatgagaatatattaaaaggacacataagcctttttaaacggctcctactggccaaatttgggatgaattgagaattataataaataatgttagtaattgattatagctgattaaatgacatagaaaaaagaatttgttctgatataaataaaccaatgaataagataaatatttgttgaggaacaggatatttacatggtctcaccttgtcacaaaatacttattaattacaacaggaaacagtgaatctacattgaagaggccagtcataccccatttgaatccagtaatcagtatgaacatcattaatgatgagtcaagtcccataggatataatcagaagaatgagacatcacatcaataatgtgtaacctgtatctaattatgagggaacatcaggaaaaccaaaattgatagattgtccacaaaacaactgtcttgtagtcttcaaaaaatgtcaaagtcatgaaagtcaaggaaagactgaagaaatgtctcaaactgaagaaaataaatacaatatgacagctaagtacaatgcttacttgtgatccagagctttttgtcacaaaggccattattggaacaactggtgaaatttgaatagaatctgaaaattagatgatagccctgtggtaaagttaatttcccagagcattcgatgatagcaatgcggtaaagttaatttcccaattttgatatttatatcacagtcatgtataaaaaaatgtcctcatttgtgagaaatacacactagagtacttaagagtagtggagaatcaatttggcaatttacactaaaaaatttgcaggaaaaaacattcctttcactatattggaaactttcctgtaagtttagagttagtgacttcttgacaaacacctgaaatctgagctttaaaactgtaaaatgaaactataagaaaagaggaaaaaagatacgatgctgaattaaacatatgtatcacatacaagtgccactcttggatgaaatgctcttggtacagagcctgctggtaggttaataggaggaacataccgatttccatgccatgttcaaaggtgaatttgatcattctatgcaaattatatctgtactggagacttgtaattagtctaagcataatatgattaggtggatgaaatattttggagtttggttttgttttaaatgtaaatactcatgaaaagtaaaacatactgcactgtgtccctgggaatatttttgttatctttaaaatactcagtattataggcatttattaacacagccttacatttgcccggtttgacctggaggccgaaatgaattgtgacttatgtcccagctggtgttcccaaattatggcaaggactggatgtcatttgttgctgtgaatgacttcttgccagaaacctgagatctaagcatccaaaatcacactccaagggattcctgaaatacactttttttttttttcttttgagacggagtcttgctctgtcaccaggctggagtgcagtggtgcgatctcagctaactgcagcttccacctcgcaggttcaagtgattctcctgccttagcctcccaagtagctgggactacaggcacgtgccaccatgcccagctaatttgtgtatttttagtagcgacagggtttcaccatgttggccaggatggtctcaatctcttgacctcgggatcctcccgcctcagcctcccaaagtgctgggattacaagtgtgagccactgtgcccggccacatatttttttttaatcttctatcatataatcattaggtcgttgagcctttcaaaatcttctgtttgaaaacatccccttcaactctgtcgttgccatgtgaaaagatcaaattgaataatctactacccagtgtctctttatgtatgaaggctttaagccaaacacaggataccattgtcttaatcttcctgctgtataacaaaattacttaaactgggtaattaataaacaatagaagttttttgctcacagttgtggaggttggaaagttcaagtgtctagtgagatctctgtgctgcatagatggtgacttcttgctgtgtccacacatagtggaaagggtaaacaggctcccttgggcctcttttataaggctactaatcatatttatgaaagcagagctttcatgacctaatcacttcccaaggctccaccttttaataccaccacctggggatttaggtttgaacatatgaattttggagagacacagacattcagaccatagcagctatttacccatgcaaataacaaatccagtgatcaagaagctagtcatcaccacagttggtcagttgcaaccactgaataaagacaatgggatatttagctggaaagatgttcagatgacatttcttttctaattttcattgaaatttttcaaagctgctagaagttagacttttttaaaaacactcccattaaaaaccagagaagctatgctcttgtttatattggaatcaaaccaaatttaacccccttttaagattttcttggctgtaagaatttcttggtaatggctgaaagagccctgattatttttttaatttgacttttatttaagttcaggggtacatatgaaggtttgttatataggtaaacttgtgtcatggggtttgttttacagattatttcatcacccaggtattaagcctatacccattaattgttttcccgatcctctccctcctcccaccctccaccctccaataggccccagtgtgtgttgttcccctctatgtgtccatgtgttctcatcatttagctcccacttataagtgacaacatgcagtatttagttttctgttcccgtgttagtttgctagggataatggcctccagttccatccgtgttcctgcagaggacaagattgtattctttttgatggatgcatagcaaataccatttgacacagcaataccattactgggtatatacccaaagaaatgtaaattgttccattataaagatacatgcatgtgtatattcattgcagcactattcacaatagcaaagacatagcatcaacccaaatgtttgatcagtggtagacttgataaataaaatgtggtacatatacaccatggaatactatggagccctggtgattttatccagttgatgatacacttgggattactaaagcatagccatagccagttaggccacttcgtgttattcataaggaataagtcaaactttggactgcctggtaacatttcttcatattaagtcctaccttattctgagtgcaaatccatcatcaggtagtacctgttttctccatggactggacagggtgcatttataagcccatctttgtgtttagactgtactattaagaggaatatagcaaggacacctcttctccatttcacatgaagatggatgtattaagtattaactaggtgtttgcaaaatactttcaaggaaaaaaatgcaataaaagtgctaaatataattattattaaaaaattatgacaatcatttagatgagtaattttaaagctcttcattaaacatgattggatattatgttaattcattaagctctacttcaagtggtagataaataaggtgcattattaatatgtcataaactaaatgaaataatgcctcataggcctattatttttaaagtgccttgcaaatattaacaaatgcttacattcttttgaggacaacttgtacgatttgataggaattgttgcagtaattttgtttctcataatataaaatgcttactacaaaacctagggtctttaaatttttcagtctgtcgttttttttttttttttttttttttttttttttttttttgagacggagtctcgctctgtcgcccaggctggagtgcagtggcgcaatctcggctcactgcaagctccgcctcccgggttcacgccattctcctgcctcagcagtctgtcgttttttaagtaatgtatacttatttaaaaatacagatacatataaatatgaaaataaaattgttgctaatcactaaactacccaaataaagtctttgtgaatattttagaaacttttttgtcagttttctaagcttatatttgtgatctgtgcgcttgtgtatgtctgtatttctttcacaaagtgtcttattgtatataatgtctcatatattccatttctagttaaaatattaaacagaccacccttcccacactatttatgggcttgcaatgctattttttcactaaaaacaagtaaagaaacaagcaagtaaagaaacaaaaaagcagggtttcttagacaaatggctaatcctaggtctggtgtataagatgagcctgaaacattttcataacagatagtaagaaaagtagggcccatcaagagtactcatgatccaacctggagcccaggcactcacagcatcagaagccaactggctgaatgttggacaattcaggcaataacatcaatggattgaaatacatcaaatatgttaaaaatccatgccttcaaaataatacaaaagtaaaaaaataactgtttaccaatgcaggatgcttgtaaatcaacttatgattaaaacaacaaactaataaatagaaggaaagaagaaggttttatcctgttttaaattgtctttatttgtattaaatgtatgtggtaagtgtaattttgttacatggatagatcatgtagtggcaaagtcaaggcttttagggtattcatcatccaaattaatgtacactaagaaacttcttatcatccatcccctcaacctccccctttccaagtccctattgtttattattccacatgtgagcatgttatttaccgcccactaaatatctatgtccacgtgtgcatattttctagctcccacttgtgagaacatgcggtactttctgtctctgagctgtttcacttaagataatggcctacagttccatccatgttgctgcaaaagacatgattttatctatttgcatggcttcatggtattctattatatacatatgccacattttatctcctctatcaacaagtaaccaaatagtagatggagtttttttttttaatagaagtatattacagctggcaagtgagaaagaactgtcagaattagtataccacaattttccaactctaaattaattaatagaccaagacattgattattaacagctgttaacatcaataaaacagagtacaactaaatagcatatacttcctggtgaaataatgcacaccactcatgaactagtattgtttaaaaaatatgaacctagttctggtcaaacttctagatccaactactaatttatagaaaatcagatgatggagaaatatatgagatgataccatggttgaaactagcaaaaataagattgtagggaactctacaaggagaaaaaaaaaaccctggttcttccaatatacatacatactgaagagaaagagataacaagaaggaaacctacagggtaaaagaaacttaaataaaaatatcaaacaattgtgaaatgtgaatcttatttatattttaatttaaacaaaaagctgctgaaagatatcgtcaacatttgtgaaacatttagatatgtgaacactgaatatttgattattttgaaaaacattgttcacctttaggtgaaataatagtgtgtttatgtgtctatgtgtattatacatacacatatatatatatatttaaaaggatatttgtcttatagaaatagatcctgaaaaatgtgtatggataaagtgatatgaatttcctttaaaataattttagggcggaaggtagccacaagataaccatttattatactcttctgcctacctttacatatttttgaaatttaataataaaatattttaaaatatactgacttttctttcttataacaaagttttctttgaagacatgtgatatggtttggctctgtgtccccatccaaatctcatcttgtagctcccataattcccacatgttgccagagggacccagtgaaagataattgaatcatggtcagggccaggggggtggtttcctgtgctgttattgtgatagtgaataagtctaatgagatctgatggttttaaaaaggagagtttccctgcagaagctctctctctctttgcctgccaccatccatttaagatgtgacttgctcctccctgccttccactatgattgtgaggcctccccagccatatggaactgtaagtccattaaacttctttcttttctaaattgcccaggctcgggtatgtatttatcagcagtgtgaaaactgactgataccacatgattgccaaggtttccctaagcatgattaataatatattattgcttattaaatagatcagagggtctaaaacctacaaactgtgaggccttgaaagaaacttgatctagaatttttgtattccaattttattatatttgtctccaaaatttatctgtttttcttacactgattattaaatagtctaatcttttcccattattgtgaaatgaccctgttgcttcattcaagtacactgtgtatgcttcagttctctggcatgtccctgggctaatcctgggttctacttattcgttatttgtctcactgcttttcagctcctccgtttcttttgaatttctctctctctttctctgtctctgacacacacgcgcacacacacacacacacccacacacacacacacacacgagaatttcccaaatgtttgatccttgactaaccatttttatttaaaagcagtaaaaaagcagattggaaaccctggatataggggttaattgagttatagcagcagtgataagtccttttgctttggctggtctgtttctacagcaataaatcttccaatcttctgccttgtctgccagctttctagaagttaacagaagagcttttcttgagggtggggatataggaacctaatgctccttatataaacttcaagacacctgtgttttcagctcaccccactttcagaggtacctgattccttcaatccctgattctttccagcagtcacatgcaggaatgggatgcttcctgttggttttcctctctatctgcataggtgatgataagtttctaaagtgtttgcttcctaaatgagttgtgactataaagaaactttctagcttccaaaccactggtgatatctatgcttattttcttttattcttgagggcagatgccttttctcttctttttttaactgttaaatgaggttttgagctgttagagataagttccaaaaataactaaaatcataactctcaaaatgttaaagattttatttaacttactaatgaggaaactagtgagacattacaaccagttcaaagaagaatccaaggaacagatgcatttataattagcaatatttaaatgaatgtgcaaatagaggcaaaatttgttttttcttcagtaggagagcaaaatcaattaaaactctaccagacaggacagaatgtgtgtgtctatggacggggatgattttgcattgcttttagttattggcaatttacagagttgtaaaataactcccccagaattggaatcatcagatatcacagaaaagtatgctaagacattgcccagttttccactgaaacacatttttcccctacatggctcaaacaggatgaagccatgggttcaactattgaagtttaagtgagtgtatccatacctaattttcctttctttcttttttcttaggtgaactctactagacgatgaagtaatgcctgcatgtttttctgtcaatacaaaataatcaataatttgctttacagttttgagaaaacccattgatgctatgacaaaggttgcctgccttttccattttgctgctgttttcatattttttcttttttcttctaaacatcttaatgagtcagaagtatcatgatagaaaactgttaagctggtattatatgataccagatacccttgaaaatatctcatctatgcagtttcaccaacatttacacaagacttgaaaagcacccaaggtctgtcatagccagagaatattttctcctccagcactttctgtaaggtgtgagatcatttgatttgtgcatgagatcaaaataccagatcaagtgcatcagtgaatttctaattcttggaatgccttgtgacagtcactgtcttggcctaatcagaattgttatttactttagaattgccccacccatatggtcctctcaacagttcctggtgtccacagcccaggctgctgtcagtgttccagttccttgttgcattcataattgctccaaagtcattcttcaatgtgcaaactctttctgcctcaaccattatcagttgaacaagtatatttctatggtttgtgctgtttctgttcctgaatgcaactgcccaaatccatggcaaaataagacctttaggatataagaatatgaactcttcttgaatactactgcttttcatgtcttcttcttacgtcttccactaagtctgcagtaagagacttgcagcccctatggttataggtggggaaaaaacaagagtgttgtattgagacctgccttcaggcctctttcatttttccaaatccctttcttctatgttttctttttttaatttttattttttttcctatcttattgagcaacttctcttctctcagctatagtgcctggagataaaagctgtcatattgcagcttaaatacagtttcaacatatttcagtagcagctatacaatttctatagagtcagggattaacgtcagcagtttggttggaaaaaggcagggagaatattgaaaccatgttcatatgacacttgacatagaattgaggaaataacaattttccatgacaaagaatgagaaggaacaagtatgtattattggggatctgaatgcttgatccttgctacctcctaacctcttggccctacagctgactctattatgccctttgagaaacatcgtaaacaaaagtagtgggggtggggttttacagaggcaggcagatgagggagtaatccacaagtttatgggagtaatgaggtaagatggagatggaacttatcttgaaatatgtgagagcagagtgatcatttgcactcagccatttcttaattcttagaacgcaaaaggatggggagacttctcaaccttcactgtgttccaacttctaggaatttaggactcatgtaaagtacaatatggtcacctgtcacgtgtggtttgcattcctgttctttctgcaagtacatcatagcatgtcccccagtttttcaagtatatgacaaatgtgatttaacttcccattacagtaaattacgatgtcgaagacaaacaaagctagatgttggttaaagacgtccagcagttggttaagacagattttattcatataataactattacaatagggaagagagtctattgtaaactgagctcaactttgccagagcaagagacagaagtgttcttagatgctggggtatgctcaaggaaaggcactgattggtgttaagcatggtgggggagcagagatcagaccatgtgattgggccgtcagggtttgctaactggtgcttatccagaggagaaacaaatttctcctatctttctgtcagaaggtagtaagttggaacaaggtgcccaccaaatttaggcctttatcttcccacagggactgagagagaaagagataactttttaaacttttgcatttcttttttttttttttgctgttacttcacctttatttttttatgttctcttttttaattttattattattatactttaagttttagggtacatgtgcacaatgtgcaggttagttacatatgtatacatgtgccatgctggtgtgctgcacccattaactcttcatttagcattagatatatctcctaatgctatccctccccactcccccgaccccacaacagtccccagagtgtgatgttccccttcctgtgtccatgtgttctcattgttcaattcccacctatgagtgagaatatgcggtgtttggttttttgttcttgcgatagtttactgaggatgatgatttccagtttcatccttgtccctacaaaggacatgaactcatccttttttatggctgcatagtattccatggtgtatatgtgccacattttcttaatccagtctatcattgttggacatttggtttggttccaagtctttgctattgtgaatagagctgcaataaacatacgtgtgcatgtgtctttatagcagcatgatttatagtcctttgggtatatatccagtaatgggatggctgggccaaatggtatttctagttctagatccctgaggaatcaccacactgacttccacaatggttgaactagtttacagtcccaccaacagtgtaaaagtgttcctatttctccacatcctctccagcacctgttgtttcctgaatttttaatgattgccattctaactggtgtgagatggtatctcattgtggttttgatttgcattttttgatggccagtgatggtgagcattttttcatgtgttttttggctgcataattgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtactgcctaggttttcttctagggtttttatggttttaggtctaacgtttaagtctttaatccatcttgaattcatttttgtgtaaggtgtaagaaagggatccagtttcagctttctacatatggctagccagttttcccagcaccatttattaaatagggaatcgtttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgccctccagctttgttcttttggcttaggattaacttggtgttgcgggctcttttttggttctgtatgaactttaaagtgtttttttccaattctgtgaagaaagtcattggtagcttgatggggatggcattgaagctataaattaccttgggcagtatggccattttcacgatattgattcttcctgcccatgagcatggaatgttcttccatttgtttgtatcctcttctatttcattgagcagtggtttgtagttctccttgaagaggtccttcacgtcccttgtaagttggattcctaggtattttattctctttgaagcaattgtgaatgggagttcactcatgatttggctctctgtttgtctgttactggtgtatgagaatgcttgtgatttttgtacattgattttgtaccctgagactttgctgaagttgctgatcagcttaaggagattttgggctgagacaatgcaacaacccttcatgctaaaaactctcaataaattaggtattgatgggacatatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaattaggcaggtgaaggaaataaagggtattcaattaggaaaagaggaagtgaaattgtccctgtttgcagatgacatgattgtagatctagaaaatgtttgcatttcaaagagacacccctctacctcctgcctccccttcacagtccttgagaagacagtttggggtggcagaatatttacatataaacaggcagagaaaggatttataattgcaaactttctaaagtatctgctctaagaggagctttaggggcctataagcctatcacaagcttttgactggaacaaacagtaaattctcctggcagtattgtgctttctggtgcaggctttttttttttttttttttttttttttctgagacagagtcttgctctgtggcccaggctggagtgcagtggcactatctcagctcactgtaacctctgcctcccaggtttaagcgtccctagtaactgggattacaggcacacaccaccacgcccggctaatttttgtatttttaatagagacagagtttcaccatgttggccagactggtcttgaactcctgaccttaggtgatctgcccacttcagcctcccaaagtgctgggattataggcatgagccactgcgcctggctggtgcaggcattttaatgagggtaggatgatctttgggacacagccttaaactgctagaagctatgctaaagttaagtctcttagtggtggaatttgggtggactgattattgctcagaattttttgtagttctcagtggaagttctttttttaaataacccactagtgaccttattgttgtaatggtggacattggcagtgaaagactatctttgtaccagattacaaccctgtaagcttctcaaacactcagaaaaatccaagaattctcaagaaattgaccctgttcagtcaatcaagccagacaagcatggggccaggtggtactgtgagatttcttggagtccagtgaaaacctaaacaaccaaacaaacaaaagtaatgtgacctagttaccaaaatattacgcttcttctttgtcatgatatgtatatgtatgtgtatgtctccctttacaggccatgtagtatatttcccacccttaatattaatattttgtaattgttacagcaaccttaagaattttcctaggctgctattcattaaggaggatactggccctgggctatgcttgcagcttccagctcctcccagcgagctattaattctctaaaaatgttttggtacttaatatgctgcctcctaatttatagcatctcactaagaaggaaacaaaaacaaaaaaaaacacctaatgttgtttgacctctgctatatcagcatgagggacacatctgtgtctcaacagctaataaaaatagagtcacaagggtgatgggcaaattttggtgagtgatttttgttgttgattaccacagacactagaactaaaatttcagtaggttgctactgattgcatgtcatggaatgctgggccatgcatccacatcagtttaagtaacagtggttaactggttaagtcattttccagacacagaaaaagtttgaggtacatattttttcttggtaatccaaaagaacttccacatcatcacgtaattgtttatttgctatttttacagacatttaaaaaatggaaaaacagaaagattcagtagtcatttagcttttataaaagaagcagatgccagggccccacctacagagatctgacagagttggtctgtccacacagagcctagatttttacatttcatcaagtgattttgatatatttcaagcccacacattgggaaaaactgctttcagacacttaacacatttaaacagagaagctttagctcaagtttgcatacaaaaatctataagtgatggaagcatataattgggctgctggttgagaaaggcagaaagcaacaggaggccattgagataaagaggaaaaatggtaagaaaattaggccaactatttgtagtgcactcatttcattttcttgtttagtttacattggttagaagaagatgacatggactaagtgtaaggtgaggtagtgggagtcgagaacaggaagaccactttagggtggggaggtctagaataagaagctgagcttagaatgtgatgtctgtgtgaaaagaactttagagatctccagattaaaaagagatctccatatttcctaataaggggaaaagaaaagatatgtccaataaaagagaaataatggggacttctaacaaatattgatgaagtgaaggaatgagacttccaagactgggtcataaaggacaccacagctgttctttgctctctcaggtcattctgtctggggaaagccatctgccatgtcataaggacactcaagctgtcctgtggagaagcctacatgacaaggaactgaggactccttggcaatagccagtgacgagtttaggcctttagccagcagtcgtgagtgtgccattgtggaagcagagcctttggcccataattttcaaccaaaggtgattttatacccccatggacttgtcaatgtctagagacattttggttgtcacaactgggaggtgggggtaatactagcgtgtaatggttggaggccatggatgctggcctcatagatatatgaggtatatattcatccccaaatatcagtagttccaaggtaaagaaacctgctcagtcccagtcaagccttcagatgactgcatcccagttgacatttggactgcaacattgaggcaggatatttccctgacctcttcacgggactcacagagggagtgcctcatttactcaacccacagttcttgactccttgtgggaggaagcacacaagtgagtgaggcaggaactggagtgcagaggtgctagaactagccagctgctttggcaccagcaggggtgaacttcattcacttggacctgctgtgatctgcccctggtgggaggaagcatgcaggtgagttggtgcaggagccaggatgagcgcttttagggtgccagcaggagtgaactccattgtgggccctgcagcagcacctggagggggtgcctgcaacccatgaagccgcagaggcagctgccttccaccggtgagggcaaagggtcagtgtgacagcctttttgtatccacactcttggctcctgagcccttatctagcatctaggagaatggaggtcacacgaatgaattgaaggatggtaaatgagggggattttattgccaatgaaagtggctctcagcaggaaggggagctgaaaaggggacagacgagatgggaagataatcttcccctgaagactggccatctccagatggatttatctcagaagttaggccctcaaggtttccctctgaagtcaagctgcttctctcctctccccaattgtagcctccaacatctagctgcttctcttctctctgctggctgagcctggggtttttataggcagaggatgtcaggtagggcaggccatgggtggttttggaaaaggcaacattcaagcaggaaaacagggatgtcagttctcactttgagctagtctcaggtttttcggcttgagggtggggctttgacagggacccacccctgtctgcctagaatttctcttcctcctgtccccatcaatgtcatgagagattttgagccacagccactcagttcatctgctccaggatttctgacctttcaaatgtgtgtgagataataaatgtgttgttttaagctgctgagttttgggttatttatgcagcaataaataactaatacagcccccaaaatgtttctctagggttggagtagatattttaagtaaccaaatcaggctggtatttggagggcataagagggacagacagaacatgaataaatatttctgctaaatagcatgttgggcagtaaagtatattttattatcatagttcatgagacttaccaaagctcaattagtgatgattataacaagtggcttgttaaagctgaaacttacatgtttcatacctcttggcagaaagacactggtaactgtcaagatttccaggaataattaagagtgctgaatgaggcagcaaggccttatggaatcagtaagtaaagaaaaacagaagttgcatatttacaaactgaacagtgaagtgagtaggtgataaatagagaagctaccaggatagaagcaaggtatgttagagatgatgctgtcatctttgtaaactttagtggagggctcaaagaagagaagttgaggctgatgttctgcaaatgtgactgaatgcaaactccctggagagcctgtggaaatgcagattgaggggctgcagattctgcatttgactaacaagtcccaagagaaaatgaaagaacttgattctgtagagaggacatttcttcttgtaaggcctcagagatgaaagggaattatattgataagacacacatatttggaagatgagaaaagggatccattctcatacaactagttcaggtttttttttaaaaaaaaaaacaaaggtggtgggggtggatcaccataatcctgccaagagtgaaagtaataggaacagagggggaaagcagcagaggaagggcaatggtttggaatagctgcaaggaataaataaagtggcgatgagctgtgccataagagcgagggcctcatcaagttgggataaataggatttactgagctacagtacacaatcacaggaacaagaggactagaagcttcagcttttagaaatgccacacacatacacttctaggtggcaggggggtgcaaagccagagattacgtactactgcgggtgtcttttctttcaacgagactctgtggcagccaaaatttgtagctgaaaagtaagctgcacagagcagttagacaagagcactacattatttgtgcagttttttgggggcttgtgaaatggagctagaaataccattttttttcctggggttgcatgggatgcgaccgtaagtgaatacatcatggtgataggctggacatgacccctttccctcttaagtgaaggttgaaggagctatgttgaatgagaggatttaaaacacattttactattctcaagaattttatctctcattgcaggctttttggcaggtagttaagattccatgcaaatcattttaaaataaagagggttgtgtgctcactgactgtgtagtgttcagtcttctgaatatatcttggtgtcattttccaataaaatgagcaggaatataaaccttgggttaaaaataattcagaaatagcagttattctatccctacagcatgcaatgtgtaatctttgaaaacaaaattactcccagacacacagaaatgcttaatgtataaagcaaaaagctattattatatagtcatcttagatttcttctaaatgtgtgcacagcacaaataattaataagtgaatgaacattgttaaacatgcctgttcgaaagtctcatcattagttatttcattatatattaattgttttcctgtattgtataacttttttctgttgatatcaaggtaaataaaatatgattctttttccaaggatttcagaatctattaaagagacagctagggaaatttatacagcaatgtaataaatgatatgttaaagataaacattataggaaataattcttctccgtggaaagaaaccttccttggtggctgaatcttcaggtaacatagaagtttgccttttgatatatttttaaagtgttatacgtatctcccaccaaaaatatattattggtacaatttctgaagttttaaaaattataaacaattttatattgactctgaaagcaaattattgtctaaatcagtagtacacagtttattttactgagaaagttttatttgccttaactattatataaaatatattaaataaaatgggtttttcatttaaaatgatatactgtcttatttcttatatatcagaataaattccaaatggatcaaggattttcgtgttagaaatagtacagtgaaagtacacgaagacaaaataaaatgatttgtatactttcttaatgaaaaataaaggataaaattgtcacatttaaaaatattctacagtaaaaaatggcattaaaaaacaaaagaaaaaatgacaacctgtagtaaacatctttgcaacaaataagcattaattttctaaattcatagaaatatacttaaaactgaaaatcaaaggatcaataaaaacaataggatatttttaagtacatgaaacagattatgcaaacacacatgaaaaatgcacacttctttttttcgggtgtggaacattaacataattagacatgaattttccttcatccaattgacagttgttcacgggattggaagaatgtggagatacagataccctcctctactctgggaaagggagtaagatatccttaagacaaatttagtaaaaactgcaagaaattaatggagcaattttacttctacatatctatttatcctacatatctatttacatgtgttgatagcagtaatgctgattacagtattgtttgaaagaaaatctcaaaaacaatctaaaagctcatcactaagaactagatcaattatcatgtgtccataaaacagaatattatgtgactattagcaagcataatataaatctatatatactgctttggaattaattatatcaaagagatgtagatataggactaaacacacacaaacaagatgtcaggacatctttgtaaaattttctcattcattttaataaacacacatatgaccttgtattagtttgcactctgaaattactgatatttgacatttttaacctaaagaaaagggactctcatagagttccaactaatatctaaaagtagtttcttgaaggatagtcaggaaactgttaaaactgtttgcctctggggagagcatctaatgcagaaggcaggtgcaattttaagcttttaaacaagttcatgtattacttttcagctgaaaagggatttttttaattacacaagttaaaataaataactgcattggcaacagacaaaaaaattgagcaatatattgaaaaatctttacataatccctatcacttatattacaagaactttggtgatctcttacttttctttctttctttcttttttcttttttttttttttttggtagtaacctccacatgctggaatgcctcagagtacattttaatatgattgcatcaaataaataccaaatttgaaaatagaaaagcattaaaccaattacataggtgtccactttaggttttcttgaatgtcctgagaatggaaatcatatcaaacaaattgtagtgaaactttatagggtcattttctttacatatcctttccttttcctaaagaaccactcctgtttttccccttcccaaatctttagttctctagccctcatttcccattctcttttgctgcaatccacctgtctgaaccatttgcccaggtctaagcctctgtctttgcatctcagccctgcctggtacctgtccagcaagggactggaagctgctggtaagaaaggttgcttctccatcagcagtcatggaggagaaggcggatctaaaacattaagacatgccccctcttatctgtcacatcatgcctcatatatctattttataacaaccccctcaaaattggaaaataaaagatctctttaaaacttaagccaggtcatgatgtagggtctcaagatctgccctgcccccaccttgccaacctatgtggctctcttctctctcgtctctggctctcctcccctcatcacgctggcctccaagctctcattccaacatgccaggcaggcttccccacacacccgtatatctcaattcctacttcctcacctctttcaggttttaattcagttaccaccttcttggtaaaactaaccaagaccaaccttagaaaagcctttgatgcctaccttgaaatcctcatactttgctctttcactctctctggctctttattttttacatagcaccgatcacattctatataatatagcatttatttattttatgtatattgtttatcacctctctctctgttctgtctaggtcagctccatcaggtaaggggttttgttttgttttccattttgatgtcaagaatatatatcaatgtttgagatacagggagtgctagtcaagtaccttactttgagttgctgattttctttttcttctctcctgtttttacttattttttcttttttagatgtcaatattattttcaagtaattatgaatcagtttgtactttaatctgagatatcttgaagggataagtttattggtagcccatggtgatggctttgtgcaaattagaaaacaatgtcatttttgtaaagacaaagctgcaagttgtgtaacttgcagtgctaatcatgggctagtggttagactatattcaccctggggaaatacaggctaacacttgtgcaagaaaaaaggaaaaaaaaaactgtcacaactgtacattacaaatgaaggatgtaaaattactacattctataggcattgaaaagacaacaggaactattatgaaaaacgttatgtcaaagaatttgacaactttgatgaaatggacaaagaccttaaagatacaaactactagagttcgttcatgaaaaaatagataagataaataccctgatatttagaaaagaaattgaatatggtgttaagtagcttacacatacacagaaaaaaaaaaaaatccctctaagctcacatggttcacttttgaagtctgccaaacatttaaaagaaatgaaacaaaagaaaatctgattctacacaaactcttccaggatatttaaagaaggaaatattatctaactaattctaaggtcaagcattaccttgattccaaaaccagacaaagactttacaagaaaataaaaacataaaccaatattttccatgaacataaattcaaaagtccttaattatttagaaaattaaatccagccacactttatatagaaaagtatattgcatcataatcaaacaagtatttatcttagagacacaaaagtaaattaacatttgaaaattaatcattgtaattcagtatatgtactaactataataaaacatataaccatctcaaatgagaaaacttatttaacagaatccaacattcattcctgatagaaaaacaaaaaactcttgggaatgtaggaatggcagacaactttctcagtaaatggcatttatgaaaaatctacattaaatatactttttagttaaaattagaagtttgttccttaagatcaggattcagacaatatgttcatatttaccacttctattcagaattgtgaatctcaaaattattatgcaaagtaaaaaagccagaaaaaaaaaagagtatgtactaattgattccatttagagaaaacactaaaaaatacaaactaatctataatagaaaaccgattagtggttgccagggaaaggggactgtggaagtgggggcgggagagattaaataggaatagttagaaactttttgggtgaggcatactttcattattgtgattgaggttcatgatttcatggatgtatactcacattaaaatttattattttttgcattttaaatatgtgcagtttattttatgaattaaacctagataaaactgttaagggatacttttttcaatcatttttcacatgggaagtatatgttagctatgccattttgaaggggaagagaataaataggctttacagtttttatttttaaataaagctgggaaatgctaaatgggaatgaggaggctataattgttgactctttgacaatggaatttcaaacattaatggcttgttctagatagtacaaattcactgatttcattattctgagctcaagtaatctttgaaatctgggagtggatttattaccggagacataaggaaagaaatataataaacattgcaaatggaacaatcgtgaatcaaggttatattttagaattatcccaaacaatggcaagtgccttgtctagatattttcttccatcattaaaatatttcacagaaaatcatcaaaagcctggagaaatacttgtctggactttctacatgatagtcccggatgcaattatagtagtatagctgtctctgcaatttttttttaaacttttacacacattaaaatattctaggctgggcatggtggctcacgcctgtaattccagcactttgggaggatatttgataatttgaggtcaggagttcgaggccacatggtgaaaccccatctctattaaaaatacaaaaaattagctgggcatagtggggtggttgcctgtagtcctagctactcaggaggctgaggcaggagaataacttgaacatgggggtgaaggttgcagagagccaagatcgtgccactgcacttcagcctgggcaacagagcgagcgagcgagactccgtctccagcaaaacaaagcaaaacagaaaaccaaagaaaaatattctaaagaaaaaaaaaatcagttgttgttttaataggttcagaggtaagtttgccatatcttatttaccatgaatgactctagtaatggcaatgccatcaatgcctctcatcttccaatggttgccttttcttctgttattactggactgttgggactggtagcactggtcatataagatgcccacagttgctaaaggaggacactgttagaaataaagtgacggccgggtgcaatggctcatgtatgtaatcccaacactttgggaggttgaggcgggcaaatcgcctgaggtcaggagttcaagaccagcctggccaacatggtgaaatcccatctctactaaaaatacaaaaattatctgggcatggtggtggttgcctgtaatcccagctactccagaggctgaggcaagtgaatcacttgaacctgggaggcggaggttgcagtgagctgagaccgggacattgcactctagtgtgggcgacaagagcaaaactccctctcaaaaaaaaaaaaaaaaaaaaaaaaaaaaaaaaaaaaaaactggaaagaaaagaaataaagtgactactgcaatagataaaataaattgcccagctgcctccaggtttgctattttttcattatcagtgttttcttgacagtgttaaaacatttggccccctaaattcacagtttattggaacacttgatgaaagctgaatctctgtagtcatgctgttagtgactcactcttcctttgaaatgtctaatgcatagatttggtgaaatgctgttttcttaggaaagtttggtggacattaaaattgcttttgcaagtgaaattaaagacattaatgtaaagtggcagtgctaatagccagataattgcagtgttagaataaatttcagagtaattttgactaccaaccatctcttcacagctaaacttcagataaaaataaattttacatggaaccgtactgagatttctgctcaggatctttacccaattatctcttgcgttcctgttatttttttctaactgtttgagtttcatgtagagtgctctccattctttttctgtcaatttattaataatatattttgcttacggttcacttcttatcagtttaattttattttacttggacagagaatggtctgtagttttcttagtaagaaaactgaccaggctaagctatcgttgtttttttatgtcctccctcctttattttcaatgtcctccctcttccatttttagaacatatcctattttttctaagttatttatgtaagtcagatggatttactgttaatatgttaatctgtatatagtgaaaattaagaacctatttttcctaaatcatgcaggcatacattaattcctttgacaaatatttactgagcatttcctgtataccagatcatatgctaattgctgaaggttcttacttaaatatttactattccctcgtctgacaattactcactgggctcttactatatcctaggcattgtttcaggagctaggatacagtagttacagcaaaccaacacacaaactaactcaagtcctctctcatggagactgaattctattgaggaaaacagccttctccccagtccctgaatatacacccttactcacacatatatattttaatataatgtacacatataaatatataaacagcatattaaatatatagaatgtctattatatattgtaacaagtatatataagtaatattacatatgtgatattaaatacatacacaaatatgtatatatatatacagagaggcatatgttttaagtaattttattttacttacctccctattactgtgccatttcatagggctactaaaattattatgtgcctttctattattggtactctggtatatttgtgtgtgtgtgtgtgtttgtgtgtatgcgtgtgtgcgtgtgcacatgcacgcctgtgtgctgttgggcaggtgatcaatgatgataagtctgtagccagagctaagaccatgtgtgtggcgtatttatgtattcatgattataaaagtcccagtggtctgctgaggtggtctaggttggtctgctgaggttgggttgctatccaacacaaaacgcaagcactaatcaaatgtttgtttggataaagagcaagaacagatgctccaaatgaatacattaaacagagacccttgggtcattaaagcttcatgcctttgatctaacaaactcagatctacagacgcctcatcagtggtgaagctgtttcccatctgctgggggtggggacctagttctcatggagggttttgaggacaagcatctcttcctcccaatgccctgattataacaagccaggaaagagagcccaaagccaaatgcccctgccattgttggcgatattgatgtcacgtttgctgtacgtgaatagttcttcttctaaagtaatagattcatattgtttgctgtcctggctgtctcttttcttttctttcatatcttttgttgtgtttttaaagtgacttttatatatgaatacaaagcaactcacgaagtagggtgtgggttgggggcaagaagtgccctgcaggctttggactgtttgtccaccaggtataatcacactctgctttagaaaacttttaaagtcatcagcaaggctcaaacagactcttttaaaaaaaaaaaaatcatgaattctcatgagccaattcacagattgtatttataattaatagaaggtctggggtatcctatcctctaaaagatgcttagacacaaagagcagtccttgaaattatcaaggtatttgtctcaaaaccacacaggaaacaacttcagccctcagtaccagagacagacagtcaatcatagttcaaatagccacatggacaattcagaagagccaggctgaagctacagagcaagggaatggatatgtgccaagtgccagtgcccagctactgcactagcattttcacatgaactcccaggtttaaggccccctccacctctgggagggagcataacatttagatcctcttgacttgaccaaaaaagcttgggcagggtagaagtacatctctccctcaaataattagaacctgaggtaagagtcaacagcaggtataaaggctccataaaacctttgaggccacatggttcttttaactttataccttgtcctccctagcatgaggcttccatcctcaaggttacaagacagctactagagccccagccgatgtaactgtattccaggtaggaagaagaaaaagacaacatggggtaaaaagagcctttcttgaagcccatttcatgacttctatctgaaatctcttagatgattagatgtactcattgccattataaataaaaaaccatgttctcttaccaagaaaggagaataatatcggataggtaactagcagtctctgagcaaaaaggtataattattcccattgaaaactgagtctcaaagagataaatgaactgaaccaaggtcctcacagagtcagtcaatggcaactgacagttttcccagaggaacatctgttatggcatggaccacaggagtcacagcttgagtctaagcaggggctgaggttgtctgaattcatctgccattgaggtttcctgggatttaattgcataagtcaattagaattctaatttttgtatgagacaaacaaaagcaccagggtgtgcagagaatgtagatctgaaaaggactgtgaagggatgtgagggagagctataacctatctgggtatctttttttaacaatagcctcataagcacatatccaaacctaaggagttagcaaaggaggaaggagaattctaggatcaccaagccttagcatcaatcaacagggagtaaaaaagatggtattcactgacctttttgaaaacacagtgtgccctgagctcagcgagaacttcaataatgtcaatagctcatcaagtgtttgcagctttggggtgatgtgttcttgtcaagggaggacatgagcactgctgcaaacactagaaaatgatattagcacaaacactagaaatatcaggtttgtaagaagatacttgaggttacagccaaccttccacttgcttcaggttggccatcaataatgggtgcatttatagtaagccttcaattcccaaattatatctggagtttgaaaaaccaatggcaagaggcattgcctgattcaggaaacacatccaagccaactgacctgttaggtcactgaccacagttgaatgtaacgtttatgggaagcttggatcaacgaactgggcagccttattatgctgacccatggtatgtctactctttggggaggcttttcatgtggtgggagtaagaaagccccaggcttacagtttgatatttaatgtgttcaaatctgcttttctcttacacctttacccccatgcttctaaaaggaatttgtatgtccataatatatatcattacactgtggtgacaattgtactggggctgattcaaacttggagctaataaacaataaatagtttaaataatactgccatacaatttctgtcattactctctgcaccacctcctctcctccatgagtttcatcctgtccatcagttctctttagtactagctgattaaaaagtagatatcctgccaataaatctagtaagctgtgaaacatttgagacacacacttccgagactgttttcatcagtggtagattagtaacaatttgctaatgaagattttcttttaattattggggaaaaggcatttcttaattaataggaagattggtttcatccagattaattattgccgggaatgtgtcccaagcccactaggcacaagctatttaaagttatcatattagcaacaaagttaagcagcttggggtttagtcttaataatgcggaccatggtaattaagttgaggcttatggatggagggtcttcaggggggtccatgaactcataaaatttgatggaatatgtttcataactttctcagcttctcaatgaggcacatgatggccgagtatgagcaatagtctctggggtcgctgtcatccgtgttcccacagcatgcactcccaccgtccagctttcactccatgatggtccagtaactagtcattagtgaggccagaaatcagtgacaaaggaatcacagcctcgagttgaagagaccacaaagatcaccacaaccaggtctctcattctaatttttgtcactgaatgctgactaacaaagtgttagtatctcattttcttttcatcaatactctacagctcatgatccatattctccgccttctcacgatgatgtccattatttccctttttcagttttccatcatgatacatggaattcagctccatatttgatgaatatccttctattttcattcccagccattgttctgattgtttgctccatcccgttcctgaaacctgattgcaccttgttgaccttcttcagagaaggctgatttctatgtgccccttctgttcctcatgttctgaaagtaggtttgatatcctgctgattactcaagcccttcctatagcacgtacttcttcagttcttgaacaatagtgttattctttgagatacaacatatcacaattcatcctagcctgcttattatcatcaacaattttttgtagacaccatcttttattaaaatgttggtattatcccagttctacccatgaccttgacggtctcatctccagtaattttttcttccacttcatcatatccacccactttcatgatcacactttggatctaatcatcaactctgtactaattccattgctgtgctctcagaaaactttgtctcctcatgactggtttattcagtaatacctaccttgatcttttattaacctcataagcatctttagtcctttgatccctctttttttaataccataccagcaaccttaacattttcctttctttctttatcctgcttagattccttggcccatcaattcaggaacttcagtgcacctccacataacagagtgcgaagaacatttctgagtgcttatttcacatgaaatctcaacaatattttacccattgaacccaccctctctgtggtgacttttcttttccctgggcatccactctactagctttgctccaattatctggctactacttcattttttttctttcagacagtctcactctgttgcacaggatgagtacagtggcgcgatctcggctcactgcaacctacacctcccaggttcaagcgattctcctgcctcagccttcagagtagctgaggttacaggcatgtgccaccatgcccagctaatttttgtatttttagtagagacagggtttcgccaggctggtcaggctggtctcgatctcccgacctcaggtgatccacccgcctttgcctcccaatggctactacttctttacagatccatttgcaagctgagccttttcttctcagccatcagttgctggagagcctctgcttatgttctcaggcccccttcataaattactctgtattctctcccttggtgctattctttatcatctatgtgagcaagtcttcaaacctttattatagctcaaaattctccagagagatatagatgttcataactccttcccttgactgtcttaatggaaaattaaattcaacttgtccacaattaaaatgtcaattatcccatttaacctgattattttccaggtatgcttctcagagtgagaccctattcccatcaggttccatagtctgaaatcctcagccttccctctgacactactctttcccttatttgcatctaaaaaaaattgattttctgtctctcagatccatccatttcactttcatctccatttccaccaccatagcccaagttaccatttataattttctggacgaatgttgaataatttccattttgacattgccgtatggttaatcccttgaatcctcttcccaccatggctagagttctttacaaactgcagatctgacttctatcccaattctgaccctttatcctccactgttaaatccaatcatggcttcctgttgctcagtttgcttttccagaggtaatctgaaaatagaacactttattcttcgtattccagccatgtgtttattcatttttatacttggatatggtaataaatatttgtgagatgactttaataaatgcatgatacattatatatacagagtgtagtagggtacttgcacatcgtctagaaactttaatgcaacagtgattctacacaaacctcatttccatctttgggagtttgaacagcacctgatttaagttgaaagaagcagagttctgtgtttctgactggggtccacagcagagcgcccctgcctctacgtccattctcctcaccttgggttccaacactgacacaaaaatgagggactatagtcctctgaactcaggagtggtcaaaacataacctaaagcccaaaggtagctggaagagttgtgatatgattctcataaccaactcttctctaggtggcacacagagatttttgtcggtttactgaaacaggcaccaccctgaggcagtaccatggttctgagtgtaaacactgcccagatgtggctctttcatgcctcgggtgtgaggcagatgtgaagaatgatgtctccagcaccaggagcagggcttagcgatctgatgttaatgtgtttttttccagctgtgatttggatatctcaacagtggaataatttgcccaaagtacccgttgactctaagtagtctttagtgcggtgctcaaaaggctttacacagagatactgcctggaaggaaagctaatttttttttaactcacaggcctgagataatgacgaaaggagaggagaataaaattaaagagaggaagacttgagaggaggtgaaagtataccatctaccctggggcacccccagccaagtgatattaagtcttactccttgtcaagaatgtcagaatcctcttgtgtgtgtgctcccaacagttacttggaccttgggaagccagaattcaggaacatgagcagacttcatgattctgctagtaactctttgttcaccccaagaacagctctcaagagcccttctagcagtaacatctcagataacttcatgtttatacatatgtatgcatacacccacaggcatgaggaaaattttagatgcaaagctgacaacattccaaaatttttgtagaaatttgctaagcaatagaaatatatcagtgaaaataatacaggagctaaatttatacgtcagtttcttgctcaccaacgcagtttttcaatatcaaggaagtgaaaaattaaaccagcttcctccctccctcccttattttctttcttcctttctcttttcttctcctcttccctcttcttctctgcccgcaccctctcctttttaacttttatttgcctgtttgcctttacttttattttcaaagccctttgaggcagagatgaacttctggcagaatgtctaaaattagctaggttctctggaaatgcagaactatttatgatacagttggctttctcagtactacagagagccaataataaccactcttaaatgatcctgaatgtggctagtatgcttcattgttgggaaatctgattttattaccctcttagattctatatttttaatgtattttgtaaccaatgagatttccacaagaaataaggatttggccttccccttgatgagtcaagcctgcatattcccctatgagtcatgagtctgcatattattagattggagttgttcctgctagatacaggccaaatttaccccaatttgaaaatatcaaacactgtaatcttaatataatattttgatgtgtctattattaggaatggccagagcaaacagttgagatctgtaagttcatatttaggaccaagtttccatgctctgtgtagagactgagaagcgttctgagcctccatcagcagctgttgcgtccactgaataattcattcaggaaacaaggactgagtacctttcatgtgccagattatctcgaaggctctggtgaccttaggatgaacaaaaaattatgctttcacaagtagaaggaaacgagtatgaatttgggaattgtctgcctttacattatagattgcctctattttctggtgggagtttagcctcatgatattggtgagagccacagatcctgaagggcatgaatttaaggctcagctatgctacttcccatctgggaactgctgttaaagtcggtaaatgctcaagaaatcaatcagaggcccttctcctcgttcttctttattttccatcatcaccaccatcgtcacctataatcaccatgatgatattagatattggtgcaagtagaatcagagatgtgtattgtttgatccaaatattgtatgttgcaaattgaaagtctgccatcctataaatatgaaggagcagttagggagtttcagtaataagcaaaaatgaaggtaagtaacttggactagtcagccatttatgatggtaataataataataataataataataataataataataatcagaaataacaaagtaactgtgaagttgagatatttgaagactagtcccagtactaaggtgctttggggcaatgcgcagttttctaaaagtaatcattttcttgggttggacacagaataaatttttagtactttattttcctggttcttcagttcaattttgctacccaaacttactaccaattatggtttctttacttcaaaattccaaagctccccagcaatttgcagggtgagattttgtgtgactgctggaaggcacattccaaaacataaagaaactttgccattggcagaaatggcctttctgggacacattcatcaaaaatgtgaaatgagaatttaaaaagccgcaacatgccgggcgcggtggctctcgcctgtaatcccagcactttgggaggccgaggcgggtggatcacgaggtcaggagatcgagagcatcctggctaacacggtgagaccccgtctctactaaaaatacaaaaaataagccgggcgtggtggtgggcgcctgtagtcccagctgctcaggaggctgaggcaggagaatggcgtgaacccgggaggcggagcttgcagtgagccgagatcgcaccactgcactccagcctgggcgacagagagagactctgtctcaaaaaaaaaaaaagaaaacaaaaaagctgcaacatgtggcatcctccaccactcccctttggagcccaagtgacaagaagagagagtactttactgagaatcattttgtttagaccactgtaagacttaaaaaaaattaataactttatttcttaagtcggtcaagatgaccttgattctggtgattagaaaaccctgtgtctcctgaactccttgccttctttcaccctactctccctccctctgtcatttcttcccactcttatttcccactactcatcatgtctccctctctttgtctctttgccttctttcacatctctgttttttttctatctctccctcacaaatcaatattctcctcagtagtcaccccataaatgaagcacaaacacacatcaacaaaaatgtgcacaaatacatgcggcataaacacacacaaactcatttttgtccacattgcacagtaaattatcagagacttgataatacttgttaatgagctcagtcacgcttattattcagtcctatatcatttttctacacccaaatgaacaagtatggttgtagagttttggagagagagtacctgctctttatcaaacctgtaggaagattctctcatgaccaccatgttatttcaggcagtatcttccttccctagcttacctgtctagcaatagatttaaaggacatatgtaaagagaaacttaaggtcataatcttcaggactcacaaaacaggtatcttctcctgtggatcctaaagcttatacattttcttggctctcttcaagaaaaaaaacaaaacaaaacaaaacaaaaacacaaatttacaagcagagagaattcaccaaagttagcagagactgggagatccaggtcctccttttgtgttctttttaggcaatgcattgaaacatgtttgcatagagagtttcctgattgcaacctggcatctcctctctacctgcaattctctgcatttcccatcaattctcatcctccttagagggttgaacaagagatgaaccctgaagcctgggctccattctctgcacagtaagtccacctctgggaggcaataagcccaagttccaaccttcccccttaggtggaaggcagctgtgacaatgagcttgggaccctagcctgcatccacaatatgttgccagtccatgcacatagctcctcctcccacaccccaaggtcctcaccagtgcctggaaaacccatcatgcttcagcgtactatggccttaaaacagctgcaacactgtgactcctttgtctctttcttagttatgtcactctcagtaagctccagttgttacaggagaatgaatctctggctgggaccttaccttgggtggtgttgttctcattggttgaaatatgttaatgtgatcgaaaagcccagagtatctggtctgtttttagctaaatatggattaaggtcatttcagaaactggctaaagcaagcatctttgactccccgttaaggagcagattgccttgaaagtctttgatctagcctggatttgtcatttttgccactctgaagatatatggagcagtggattagtgactgtcattctttggaagcactgctgaacagggtgcagagcttggacttcaggttggacagctctggtttctgagttccaatcttgaccctgtcattggctctgtgacctcacacatgtggctcaacttctctcctctgtatttcatcctttgtaaaatgaggtaaacgatacttcataggtggtaaatacctgattacagagagatgaaccaactcagttgaaaccacacacctattcaaaagtagaaccagaattagggatgctccaatgtcacatgtgtgattcctctacaagaacaagtgggagataattaggcagcagtcaaaaataatgtgaagctatgctaacatctatttatcacaggcaaagttttgattaattaaatgagtgagaactttgttctttggcttcccctactctcttcactgtctatatctccctatccatcctatatttaaatggttatgtttcccaagtttcgggcctgaactcttctgttttctttctaggttttatccttactgatctctaatatcagcaaaatttcagttgtcttctctggcgtgtaagttgtaaatttgcttttttaagaaagcccaaatcatgaagatgattttcctgagacagtgaagactaagctgagccagaaagaagcaggcctcaagcaggcgagagtactaggaaagaaatgttttaggcagtggggacagaaagtgcaaagggtgcctggtgagaaggagctgaggccatgaggagaatggaggacaggccatgtggccagagcacaggagaggggtggcaccagaggagactggagaggaggaagggggcatctttttatattgattttaaggaaaatggggtattgatttgtttgaaaatgcacctgggtgatagacatgatcagatttatggtaaaacaaacaaaagaaatatgtgaccccatggcaaacagaagatttcaggggctaatgtcaatgtggagagtagtaatgagctttctgccttcatttacgactaattacagcagcttgggtgatcatggtggtggggaggagatgtaagggggaatgctgcagcaggtcctcaaatattgtcattttgttagactattgacaagggaaaaacaaaacaaatcaaaacaaaacaaatcaaaacaaaacaattccaggcctgggcccctgcctgtgtggagtttgcatgttcccctcaaatctgcatggtttttttgttcgttggtttgtttgtttttgtgatggagtcttactctgtctcctgggctggagtgcagtggcacgatctcggcttactgcaactttcgcctcccaggttcaagcaatcctcctgcctcagcctccctagcagctgggattacaggcatgcaccaccacacccggctaattttttgtgttttcagtagagatggggttttaccatgttggccaggctggcctcagactcctgacctcagatgacccacctgcctcagcctcccaaagtgttgggattacaggcgtgagccaccgtgcccagcccttcatgggttttctcaggtattgctgtttcctcccacatcccaaagatctatgcatgaggtcaattgctgcagtgtgagtgagtgtgggtgcatatgaatgagtgcgccctgagatgggatggctggcatcttgtccagggctggccccgccttgcaccctgagctgctgggacaggctttagcctcccttgactctgagcttgaataattgggtaaataattatcttactttttaaattcatctttcttaaatgtatatatagctcacatttgtttcaatggtaaatagtagaggtctttatttaaaattgtgtgatatttttgtgaccagaaataggcagtaggaacttaactcttatttatatcaattagcctatagtaaaattgttttcattatactgtattttgcttaaagtggcaatttctaagaacctattgatgacattaagtaaagacttactgtatttggaattaaggtgacatagattgctgacagatcagatgtgggaatgaaggaaagtgagaggtcaggataactccttgattctggcttgagtgcagaatgagtggtatgaggtctaccaggagagagcacactggagacaatccaaagtttgggggttgggggatggaagaatagcctcagctataaatcttcactgggctttcagacaggttgagtttgagatgactttgcagtcgggatccatgtgaagataccaactagaaagttaggtctggagctcaaaggagaggcctatgctaaaaatataaatatgtggagtatctttaagtaagtgaccatttaagccagtgtcatgaattcaaatgctcagagggaaagaacatagatccaggagagaacgatcctagggttcaagactgaaccttggaacttcagcaataaaaggcgggtttaggagaatgattgaattagtccagcatacaagatgttcaacagtgttgctgggcaacgtcagggtagccatatgatttcttgtacaaatgaggggccttttgaaagtgaaagagtgctaaccaggagtatcaaggcaacatgtgtaaactgggactctgtatggcaaaattagacaaagcaagtagttagatttattcaggttggaattgtgacagatatgcacaccaggaaaataaagagacaagagaactcaatatggaattagtcatcaaatgccatctagttgacattcttgcctattaatctcttcctgcatgttactacataaactttccacactatgtattttttcatattgcctcatttttgttcaaaaacaacaatggctctcagttgtcagggtgagagtttagaatccctagctaaaaacccaaactcttagttcatctggcctatctttttaatctctcatttactttaatctctcattagctttcccgagagtcatatttgcctttttactgacacttaaacatggcttaagtatcatcttctctagacttttaataagtaattgaatatagtcccctttatgatcccagcaaggaatgagccttattgtctatcagtcatttgaatctactaggaggatggttcatccagcactctatatctgataacatcgggagcatcagtttccagggaagtacattcaggtaaagtgagaatgttgtgctggatgcgaagtctcagatctctcagatgaagtcccgttttgttccccacccccacctgccgtaatgaattctttaaccacctgatgggttctcctgcccactgcacaaacaaaattaattcacataattgcagaaaagaaagagtttaattgacatgaggccggccacaccatgggggagagggaattattatctcctcaaaggcttctagattagggggttttatttatatttatttatttatttatttatttatttatttattttttgagacggaacctcactgtgtcgcccaggctggagtgcaatggcgcgcctcggctcactgcaacctccgcctcctgggttcaagcgattcttcctccccaaccccctgagtagctgggattacaggcacccgccatcatgctggctaatttttgtatgtttgtagagatggggtttctctatgttgacgaggctgctcttgaactcctgacctcaggtggtccgcccacctcggcctcccaaagtgctgggattacaggtgtgagacactgcacccggccttggggtttttcaaagattgtttgggggaagtgatgggagtggctagacaatggttgtttgttgctgattggttgggggtgaagtcatagggttatgggaaatgttcctcctgtgtgctgaatagtttctggtggggccacaagagcagttggtgagtccaggtgaagccaggtgtcagacatgcaaagaacccgaaaagacatttcaaaaggccaatcttaggttcaataatagtgatgctgtccacaggggtaatcggggaagttagcataccttttgatctcttgaataatgactggcaatcctttatgtctacaccttagcagaattcagccccctctatctgcctagcctggtggtctctcattagctttacaaaagtggttgagttttggggaaaggctgttatcatttaacctataaattaaatgcctcccaaggctagcttggcttaagcagccaaggaataattaaaagcagtttgaaggctcaaggcaagaggggagttggctagatcagatctcccccactgccataattttctcactgttataatttttgcaaaggcagtttcagttctagtactctatctgggatgtaccttacttcacttacaaataagcacagatcatattttgtatctacataactaggcaagaaccatcctgaaagggtaacaaattctatgaatccatccaaatataaaaatattcacacgatgtttctgtaattccacacagttagaaaaaaaatcatataggaatcagggaggtgtattctcattcaataatagaaacaaaatgtctttattttgcttaaaattaacaggaaaaagcaacagcattgcagtaaagaaagagtttcattgacacgaggccagccacactatgtagaagagggagttattataggaatcaacagaaaaaagtcccagcccttctgttcacatgctttaaaaaaaactatcataacatcaaaattgaacttctgtcttcattaataatcataagctaccacatattatgttgattaaaaaaaaattgaaacatctgcttggattgccttaaggaagactaacctgttttcctgctaagggtgtttgcattctttgtaactctaaaggtgaaaggacatcaggggaccgcccccagccaccctcttattcatgttcctggatcacagaaaaaggtgaacatattttggtctgccatttctatttgtggtttttttgtttgttttttttcaagatggagtctcactctgtcacccaggctggagtgcagtggcacaatcttggctcactgcaaccttcacctcccaggttcaagcaactcttctgcctcagcctcccgagtagctgggattacaggtgtgtcccaccactcctggctaatttttgtatttttagtagagacagagttttgccatgtgactaggctggtcttgaattcctgacctcaaattatctgcccccctcggcctcccaaagtgctggattacaggccggagccatggcgcccagcctctatttgttattctctagtagaggactctgaattttgatttttttctttgaacgtttttttttctattgtagtttggagttgcttttaaggggagttaacgcatttgttgggctctaggtcactttgaggcagagaaaacttcaatcagacctcttagttttcttagatatctgaactcttaatctggagcatgcattttgtaatttaaataaaacttttccctttattttcttcaaaattatctttctttctttctttctttctctctctctctctctcttttttttttttttaaaagcagggtctcattgtgtcacccaggctggggcgcagtggcatgatctcagttcactacaatctcgggctcaagctatcctgtcacctcagctttgctagtagctgggacaacaggtgtgcaccaccacacctggctattttttgtactttttgtagagatgggggtttcaccatgttgcccaggctggtctcaactcctgggatccagcctcagcctcctaaactgttgggattataggcgcgagccactacacctggcccaaaattagtttcatttgagtttacatggggtggttgaaagttttggggagttttttgtttgtttttggaatcagtttcagactatgcactttttggtactgacacttttacacacaacaagatcattcatgcaaaaatgaagaaatagaaaaatgaaactcttgcttttttctcatctttctctggcttttcttctcttatggccattttctccctctttcttttttactgtctgaaactcttttcatagacttgaacactgcttagaattatagaactattagcaggggcaaattgtatgcatctgcaatactacctcaattcttgatcctcagaagaaagaatttgaccaagggggtgtaaggcagagtgagagactgaggcaggttttagagcaggaataaaagtttattaaaaagttttagagcaagaatgaaaggaagtaaagcacacttggaagggggccaagtgggcaacttgagagtcaagtgcactgtttgacgtttgtcttgggttttgtatgttgcatgatttggtgggttgccttacttctccattgattctccctttggagcgggctgcccacatgcacagtggcctgccagcgtttggaaggggccacatgcacggtgtgtttactgaagttgtacacatgctcacttgaggtctttttcccttaccagccaagtgttctaagaggaaggacatataccagttaaactccgccattttgcctcttagtgctcatgcttgagcccacacacataactcctgagatcttatcaggaagcggctgatcaccacttcaggtgtttcctatctattgggagactgcttttccctggtcactcacatccgtgtgaagagaccaccaaacaggctttgtgtgagcaacaaggctgtttatttcacctgggtgcaggcgggttgagtccgaaaaagagagtcagcgaagggagataggggtgggaccgttttataagatttgggtaggtaaaggaaaattacagtcaaagggggttgttctctggccggcaggggtgggggtcacaagatgctcagtaggggagctttttgagccaggatgagccaggaaaaggaatttcacaaggtaatgtcatcagttaaggcaggaacagaccattttcacttcttttgtcattcttcagttacttcaggccatctggatgtatacgtgcaggtcacaggggatatgatagcttagcttgggctcagaggcctgacacctggcactggcttaaaccaattgttattttagaaagacagtgtgacaactgcctgaccatcacccgacggtcgcctgacattcttagattgggggcccctctcctgctttcctcacgcctgcctgactacctactccaacagagcaacagcggacattaccagagtttttttttgcctaagagatcactctgcctccaggactgtgggttctgatgcctactgcattttatggagctcctttcctcagaagagtgttgacaggataaaaacaaatcctgggatcatgtcttccttgatatttctgagcaccgtgtatacatatgtatgtaatgatggactcacaaatatgccactcttatactcaatatttgaggtggacaatctgacattggaaatgtagacattgttgttagacctggatttcaatttttatgctttgttttgtgatgttgactgggctgtattaaatgtcttgagttttagtttcatgatctacaaaagtagagttataatttgaaggagaactgaaaggacttgatgagatgaccattgtgctgtcttgtacatagtagatgctcaggaagtgttggatcttttcttctcactccgtctgactctggactgttgtatagtcatagtcaaaaactttgtagccaaggtctattataaaactagcatattcatcataattatggcatttcatagcaggtggtatgtcacgttcaatgctcagctaagtaattgtttaaattccatacaaaaaacaagtatttttcttactctagtgaaaagaaaaatcttgcatttacaaaatcacttgaaataagaatttctggtatctaaataaaggaatataataatataatagttaatatttacatagcattttctgtgccaggaactgttctaagtctttacatatattagctcatttaagtctcatgatgactggctgcataattagtgaggtcagtccagtgaaaaataatgcaaagctgcttgttcaaaaattattaagaattttaacatggtgatgccagagcattaaactaagagtggggcctttctgattacagggcagtgtacaaatacccaagtgacatatctcaatcttcatatcaactctatgagataaacaccattattaattgcagacaaaataattacgaagtggggaaaagctaactcacacaaggctacagggacaggaaggtttggagctgggattctacccaggtaattagtgttcagagtctatgttcttacctactggaaaaaaaaaagaaaaaagtcttttgtttatgtactaacctttattttataaattgcactatgtattttatttcagagctatgatatcaaaatatctattttgatatgatcatatagtataccatattcatctatatcaatgccatggtttgtacaaatagaaaaagatctgatgggaagcattatccatgtagctagttacaccaaaactaatatgaattttaccaatcaccaaacactattctaagccctttacttatattaacatcatataactgttaataccaccctatgaaataggtactattgttgcaatcatagtattttagatgaggacattgaggaatggaagacatatatcttgagcaatgcctcacatctaataactgctaaggtgaaatttgaaccccaacaggctggttggggtcttcaaggtactttatgttagtctcttgactgtgatgaatgaaatgtgccattgttttaattttatccactgctaaatcaccaataatcagcagaatgcctgacacattaaataaccaatcaatgtttgatgaagtaatgaatgcactgagtcctttgaaaattaaaattttaatcatgcaagtaatacatggacacatgcttcttctaaaatgctaataaaatagtctaaagaaatcaaaccataaatgtcttaccagaccactctcccgcccttgtcatgattttaatctttattctctggacttttccaggaaggaccaagatttccaggagtgttctgtgtttatgaatcgctgttgatcatgctatgagccgacagggttgacgtttgctctgcatactcaatgcagctcaatatgatcctgaatatggtgaagctttcttcagagccatttcttttgctgcagacacataataaatgccctagtttcactaggcagtttcagtggaattcaatttgaaagctaaaaatgatgcagataattataagcagcttcaattccagttactgtccaatccctgcctgaaagctccttgccaagggatgttagccacatgatcctgtggctgctcaaggttaagctgttctgggcaagagtttaaatgtgctgccacagggcaggtttacttctttctaaacaactcaggctgttttctctagagccttgaagcccagggtctagaccagacattacaggattttatgtcaaagaagagtataatattaaaacataattggggcatcgctcatggttgttaagactgacttgtgataaaaaatcatgtgaggaaaaaaaactgccttttgggtaagctttagaaggtggcaattaaggaacttgagttttggagcaaaattgccttatttgaaatctaccactgccactgttgactgaacaattgactgattctgtacaatttactatattttctgaaactcagtttcctcatttgtaaactggagataataattgacttacctcataaaactgtggtaatgtcaattgaaacaattaatgtgaaatacctaatatgctgagattctcaataaatattagattttataagcttcataaaattaaaaagtgcaggagaaacaatttcagaataactcagtccagttggaaatattatgccaatatttttgctgaaagctggtgaaatcttcagcagggactggcagaaacaccagtgctttactaggcttttcttgggcataatattctcctgaagtaaataaattgacaaataaatcaatacattgacaaatgtcatttgtcagtaaaagtgacaccttctaaaatgaaggagttactcttttggtttcattgctatttaatggtatgttcagaagtgaactgacttattaactaatgtgatctgagtgactgtgatggacattctcctccaaagctgatagagtgcctacaacacttcctgctctgtaataggcacaacataaatatatagtgatttgcaagccaccttttggaggagaacacttcccattgtttttatatcttctaatacaccagtgcttggtaaggtcctcacaagagaatgctgatacctgcatttctctttccctggtttcctgcacaggctatggtgggcgtaagctcagttctcaacaaccgcctgctgaatagaacactgggcaagggaacaaggggttttaaaggcactgatagctctcaagaggctgctctgtctgccaagagatgagagccatagaatcagaagaaaatttggagaataaaaggttcagaaaggtgactagagtaggaggaggaaaacaaagagactttaaagcgctcttctcttgaagcaccatgtcctctcactatttattgtttatcaggtacccttagactggatactaagcaaggctcgtcaccacaaaccttgtcacatgcacattgtcccttcctactctttggagctaccattgtgtttgtgaatatcacacactgttcacttagatatagatagatagatgaaagataagatagatggatagatagatgataggtagatagtagatagacagatagatagatagatagatagatagatagatagatagataatagattaggagatagaaaatgtctttgtatttatctggtgatgggaaatcttgaagtttggagtcaacctgatttagttagggtaaataatagtgcttgctctaacaagttgagtgaccttgtacagtttagtggaaatgactcctttatgggcaacaactgctgaatagttgattcattatttttaaaattatgtttaagagaaaagtattctgaagatccgaacatctcttaaatatgttatgtttgcaaacataggaatttattcaccagtcctttgatggagacttaaagcttttcttgtgtattggtgtactgtttaaatttcttacaaaactcactcccatatataatctatacatgtaatctatgatttctagcttcagtttctttaaataggacaaaaactaaaactctttgcaaattatgctgtggggaaaatttgacagatgtttaccacacaccctctcccaaacagatttgtgaaaatacagaccatgtcttaattttttttttttttttttttttttttttctgagacagagtctcactctgtcgcccaggctggagtgcagtggcacgatctcagctcactgcaatctctgccttccgggttcacgccattctcctgccttagcctcctgaacagctgagactacaggtgcccaccaccacgcccggctaattttttgtatttttagtagagacggggtttcaccgtgttagccaggatggtctcgatctgacctcgtgatccacccgcctcggcctcccaaagtgctgggattacaggcgtgagccactgtgcccggcctcatgttttaattttgtatttctccctccctccctttatctttcctttcttccttcctccctcccttcctctctttttcttcctctatctcttcctctctccccttgatcacagtatatactgtagaaccttgtatatagtagcatcatgaaataaaggaattaaattaataatgggtaacttgcctactgtaacacctaacaaacatataatattcaataaaaatgctgttaccattattgttgtcattatatgtatatatgtttatcattatgtttctacagaagcaaagtaaattggtgtctttaagataatattaaagaaatggctaaggaggcttacatgagattttcagcaaagttccaagaattgaaaaactataagtagcagatgcaacctagaattccacttaccttatagtgataaaagacactacattagtttaagtttactagcccatcctgttgaaatatgtgtgctcatatattttagtaatacttgtatttttgtggtgaaatggttatgcttccaaaaataacaaattccagtgattttagttcaaaacagttaagagctagagctagaaaacaactttcttacttgcattatttttctttacattttcctaaactatacgcaggcaaaaaaatgttgtggaagtgctgttttatggaaaaaagccctgaggtgctatttgcctgcatgctactgaactgagtttacatctttgcaaacaggaggcttcccggaatgtgctgtgtgtatatattcagagcgcccctgtgttcactgttttaagtattgggttagagatctcactaaacaataaagtagcattagctccccgtagacaggtaatcctattatctttagatacaaggatacattttaataatacagatacggagattaaagcaggaggattgagaaagcatcccattccctcagggataatgggtaatgtaatcatgctcttgcactaagcaaataaattagaagtcttgattgcatcacaatggaagagattcatacttccatttctttcaaaagtgatggcagtctgcttccaaactaaggccatttaacatgtctttatacattttttcctagtttttgaaaaatattttaaattgaacccaaaggcaaatacgtataatgctagttgatgctttgggggatatatctttctatagaaaccttcccttccaatgccattgaaaaccaaatttcaaaattgagcactagaagtaagccaaaaatcaattaccattgatggaacaaaaaaaaacagtacatttttgtcaatattactgctttctttttttcttttctagctttgaaaattaacccccattatgtatgacaatctctaaactaaagaaacagtaaaactcttgaatatattctttgtacagcctttaagtaattaatggagtacaacacagtggtctcgataaaagttccagaagaactcaggagggcaagagatgctgtagaaaggagagaggatcaaagctgtgtcttgcaaaacagaaaagattggggcatgaaaaaggtgtggagcaagcaaaggtccaaaaaattgttccagaaaaaaaactgactaaataggaatgtaggaagtatcaagggaagataatttgggcagattctgaagaacctttagtgccttgataaggaattagactttaggatatctggagtatctctcagcagggaaaaatcttgatagcaatgggtttgagaacatgaatatgggaagggagggtaaggcaagtcatctacgaagtaagaaggccttagttttgaatattaaatgataaataagaaaaaatatgaaaaatgaacaagcaagactatgtagatggccgaatagacagaggccccccccaaaacttaaccacaccctcatctccaagagcccaggtgttttttcctatttatcatctcagctgctcaatggctcatgcaattttaaagcaagaagaaataatgaaataatgatgaagcagatgcactgtgtaagtgcacacagggatgaataaattatacaaaatgcactgcagttggaaggaaggaaaggaattactgaaagaaagtagcttcatggttttctcattgagatcaaactcagtcctgctcagtaaaaacgaactaagtactcttggtctggaggcctgaccaggaccttaggaacttgtgatacaaagactggaagttgccctggttgagtcagtgagtgagtggtgaatgaatgtggaggcctagcacattactctgtacactctgtagactttataaacactgtacagttaggctacactacgtttgtaaaaaaatattttttctttaattgtaaattaagatagcttgctgtaacatttttactttataaacttgtaattttttttactgttttgtagtaatacttagtttaaaatacacattgtacagccatacacattgtacagccatatgaaaatattttctctctgtatatctttatattataagcttctttctatgcttataatttttgttttattttctacttttaaacttttttcttaaaagctgagatataaccatatacactagcctaggccttcatggggtcaggatcaccaatatcgtcatcctctactacatcttgttccactagagggtcttcagggacaataacacacatggagctgtcatctcctatgataacaatgccttctcatggaatgcttcctgaacgaactgcctgaggctattttacagttaacattttttcttttaataccgtgtactcagaaagagtatactctaaaacaaccataaaaattatagtatagaaaatatattaactagtaacagagtaatttcttatcatgatcaaatattatgtactgtacagaattgtatgtgctatgctttcttttttttttttattttttattttttggagatggagtttagctcttgttgccctggctggagtgcaatggcatgatcttggctcactgcaacctctgcctcctggattcaagcgattctcctgcctcaacctcccgagtagctggaattataggcgcccaccgctacgcctggctaatttttgtatttttagtagagatggggttttgccatgttgaccaggctggtcttcaactcctgacctcaggtgatccacccacctcagccccccaaagtgctgggattataggcacgagccaccgcgccctgccccatgtgctatacttttataggactgacagtacaggaagtttgtttataccagcatcaccacaaacacatgagtaatacagtgcactacaacatcgtgacgaccatgtcactagatgatgggactttttcagctccattatgatcttatgggaccgcagtcatatacgcagtctgttgttaactaaaacgtcgttatgcagtgcatgagtgtatttgatgcaacacagtcatctcaggaattaaagtggctgtgtctaagtcccagtagccctccgttttgacttatttccttttcctcaaaaattagatgccctttcaacctggtttgacaaaaatcactgaaattgatcaatgcatataggttttgggtctatgaaaaaatgcatattttagctctgaagagaacgataacagaacttgactgggagttgtaaatgtcagtgaataacgggttatgggacatgaagcatattttcagatttctcagagaaccatacttgggtccaaatgacttcatgttaaagaaacggaataaaatcaactcagcattcctgctgaccagctttctatctcagtaagtaagtcatcatgccctccggagcaaccatcttaggtcaatcaaaacatttggcctcattaaccactttggatttatcttaggactttcttatttatagtcttcccaaggcataatgggcttcaaaatgtacttttccctggttcatgttgagttgaaccaagttctgtgcttttactcagcaggcagtcatttgactgtcagcttttatatttttctctatgatcaaggagttcatacggctgctcctaggtgcctaattaacattcctccatcactgcatccctgcttgtaattattcttcatgccacctttgtttcctcaaccatcaggaatatatcaataggtcaaatcgttttagtacttctgacttagctcttctttaagcttcataattattagatataaactgcagataatacagatctcttatttcagcagattctgtgattctgctttttgtttgtttgtttttgtcaggagagaaattggactaaattctgaagagtggccatggtttgggaagatagaagagggtgctgcatatagggatattaggagcagagctaaaaggcaggaatcaagttgcatgttggtgaagatatgtgatgtgttcggtgtagagaggtacacccttgaatttgaaatgtaatatggtggggggaggggtggaataatataaaccttagaataagagtaggtctaggaagctggtccccacatcttcaactcaccttacagccacccagcaggcagacttatctcccaaatctggtccttttactctcttactctggttctttcaatgagactccagtgccttcagctaaatttcaaatgatttctcctgccattctagacattgcaggtcccagcacacatgagtttcctaaactaatcttcagtccttgctctcctgccaggcacctcacatttcagccacattcagtacatccttgaactcaccatgaacactcatttccacattaccacccatgtgctcacttgctcttatcttccacctccagtgcacttataaactcctacacagtatataagatacaggtaaaatataagtcattgtttgtatcattcctcagtcatagctatttacttcactacatgtacatccgatacccttgaacatatctgtattacaccatttaccacaacgtattatatttatgtacttacatgtctaatctgccacctagacttgagctcagcgtttttatttatccatgttccccttaaagattctcatatgcctgatagatggcaggtacctaatcgatgtttgttaaagtgttttggatggagaatcactaccatgttctttcctaaaaaatcccaggaattggtggtataacatgactggtcattgttaattaatgttttctactagagattgttcttagtcagtcttcatgattttttttggttaacaaatattttggggattttaatggccaaaattatttctaaaaaattgcttctgtggttgttggtcattcacttagaaaggatttactgaacacttccaattaatgagctaatttcagttttctgaatcacaacaatatttatttcccaagaagtaaacaaatttctgcatataaattagaattttattaggtagcagttttataaatcatgtagtttagaatggcattctcctagaacaaatccataggtcttttttagaaaaaaaaaaaagaaaagaaaagaaaatgtcgcctcaataattttagatgtaatttccatacacattttattgttgtgtattataggttgattactgctcctgatagatttttaagttgcttaagcatataaaagccccaatataattttccacagatagatggagagaaagaactttttaaacgcaactctataatttgtatatctgaatcctgatcttttaaagctttcttagtgttttccttagcagaaaaaatgtttatcattagaactgttaaggaggaatcatatctccttttataaagtgctttatttttcaaagtaaaggaaatgcgagatggcaccttataaaattgctgatcaaaaatggtcaaatgttggcagtttcatgtggttcaccctaatacttacagcttgattttttgagaggaaaaaggattgaaggacgtaaaaatgttatcttccagtaatctcaaaagatacctgagagagaactatacagtgaatgctgatgtactgattatgaaatgtattttcataaaaatgactgtaacctggttaaacaaggcatttttctcctggattctgcacacactagtagaataaattcagttggtttccattcctctgtcagttagtgcacgtaagtctcacccatttgtaatgtctagaaatcttaaaaagcatcagaattaccattaatgatgatgatcacagtctgctagatgcccaggaatgactaaagcctactactaaagccccagtagcagtcaatataggttatgcttcaataacaaacaagtacaccaaatccttatagcataacacaatgtttatgtttaaaattgtgatatgagttgaatgactttccagagcagattttggagggggagaatactcaattatgtacttttcattaccacaaactgaagtggcacattctcagttctagttacattttatttgctaggactctggtctcaactaattggaagacgaaagtgaagtacaatgaatgaagaaaggagaggaaaatcagatatggttgagcactaaacatctttaccatagtttgtaagactaaatagacttcgtacattttatttagtatttttttcattcttgcttggggaaatctttccaagatacattgccaaactggggtaaatgaagatgaaagaaagtctgagacctaagaggttgaatttcttgaaactattttataatgaccatttccttacttctttttgccttgttgattctttccttgttcattctatttaccacaccagacataactccacatagcaagattttgccttgtctgatgccttcattttcataatttatttccacacatataagcagaatgggttacaatggcagacagaaatctttagctttgaaatagaatggccagtgagaagcatgcctatatgaagaatctcatatagagagaaaatttaaatttcaatagagtgtttttcttaaacttagaattggccacttttttttttttttgtcatttcttttcacttcacaggaacatagggaaatcttaacttcagaagcaatttgcgtgcaatctctcttcctggatgggtgaggattgcccccttcagctcctgctaagctttatcaaatggagaaagcctcatttcatgcaggcaggagtggagagtggctctagtgtgcatgctatcctcatcctccaaaatatttcacataaataatatgttaccatcagaaacataaaatatcaattatatattataaagcagaatttataattctacatagagtgtaactgagcaaaaattccattgaggtataaaaacagaaaatgcaaagaatctttgctcatatgaaactgacaacatgccatctccccttcatatgactaaacctgctctcccaatcccattgtaccatttggagagatttacatcaatccagaacaaaaattactcactttaccttaagtattgttagcttccttatttcattgtatttcttcagttccttcagtttgtttttaactgaatattggtttctattggtttcttcagttattttttaaatgatgtaaaaataaagtttatctcatatccctattaaaatctctcaacactcatgtctccctgacagcccctgctcattctctttcttccagcctggtacttccttcacttctctccttcctcctctttctccttcttctcctcctctttcttctttctttttccttgtctttctcttgtttttattttccttccccctcttcttccctcatctggaagtggcttatgatgcacccgaatcagaatcccgacgaacaaaaattatgattatctcaaccttaagaaaaacagctggattctagaaaaccctcaaagaaagtacgagatttgggaaagaagcacaaatgtcccccaagtccctaccccactctctcatgccgagaaaaaacagcttcacaacacaaagcttttatgaagggctagcagttccagtgatgggctcctgagccctgagcctaactggtgcctgttgacctcactgctgttcaaatactgtcttcttgtcctaaaattagacattacctttatttgattttctctggcactgtctgcctgccaaccagctgcctcccctgccacccccgcacacactggtgatgcattccagatccaaatccaagtcctggttgctgacatgattccagatctcactgactgtgggatttgtctagaattatgaggccaagtctcatattttgagatatgaagaggacagaaacataaatagacccagaacaggatctcagtgttacttttttatctgtgtgaaggacaacgatctctccattttattctctctttaatacctatttccaaacataagaaactggaacttatgatgtgcctatagtgtcaaacattgctccaggcatggtacttgcactgtcttgtttaattctcacacaaacctacacaagaactgttatgattctccttaattgatgaggcgccaaagtccagagggatcaagtaacttgcaaaggctcacagtcatgtggctgagcagaggttccaatccagggcatgttagtgcacacgggctcttccctagtgccataattcctcccctcaaataagattttcctggtaatttgtgttttttgaaccaataagacttaccctaataaaacaggataaaaggtaacaattggcaggcgcagtgcctgtaatcccagcgctttgggaggccaaggtgggtggatcacctgaggtcaggagtttggccaacatggcaaaaccccctctctacaaaaattagccaggcgtggtggcagagcctgtaatcccagctacttgagagtctgaggcaagaaaatcgcttgaacccaggaggcagaggttgcagtgagctgagattgcatcactcactccagcctgggtgacagagtgagattccatctcaaaaaaaaaaaaaaaagtaacaattaattccatttatatgggaaaactagatatagagaatgtatgcaatttgttgactcttttttggtaaaaagaactagtactagaaattcaaactttcaagcttctagttcagcactttttcaatgatattgatacaagatattttgctccttagctcagctaatctgggttcttgtctcaagaccaggaagaattaggcatgcagacacattgaagggtgagaaggatggaatgtattaagccaaaaagaagctctcagcaaagagaggaggtcctgcaagcaggtttccacctcccaaattgaataccagggccaccacacaggagacaaagaggccgagctccttccctgcataaggcgtgaattcctggtggctccaccccattccccaagtacaggtgggcctctagtccattgtgggcatgcccaggcaagccccctgtgcagttccctcatctgcacaaaacatctggtgtaaacacttgtgggatgggttggagattctgcagggattcttccgtatctgcgtaggcctttgtctgcctcctgcctctatcaatatcttgatgtttagaactgaggggaaaaatatatggtaatttttgagactgtgaggcagagctacttccttcactgtaatattcatggccctgaatgctggccaacagagggtcaggacacaggaagggaagcagcatcttatagatgggccgcccctcaacactgtttgctgcgctactcgatgtcactatagaagatgttgctctaccccaggttgcctctgcccactcctgtcaatcttgtttttcacaattaattattgacctatttgatcttcctaatttccaattagccacattctactttgtccaatttccccaatcctatcccttagtataaaatcctgctaaattgcatttttttcaatctccctaagtaatgtgatacatgatgtcaagccaacagcattcatttattttaaataaacttacagctagaaattttgtttctttaaccacattgctagacttgaataaagtattttatttaatgaatggacgatgatgataattgcattttttaaaagagcaaaggaatcattaggtattgcctgttttccaacaatactagattttattttaaatatgtcataattatttctacctgaagagcactggcactggagctagcctgccctggtacacatcgtggctccatgtcttaccagcggtgtgactgtgtgtgagttactaaatcactccgtgcttaggttttctcctacaaaacaaagataataataattcctctattatataattatggttagatgcaaataaaattgtgtccagaatttattccttctggtgggttcttggtctcgctgacttcaagaatgaagccacggaccttgcagtgagtgttacagctcttaaaggtggtgcatccggagtttgttccttctggtgggttcactgacttcaagaatgaagctgtggaactttgaatcgagtgttacagctttaaaggtggtgcagacccaaaaagtgagcagcaactagatttattgtgaagagtgaaagaacaaagctccctcagtgtggaaggagacccgagtgggttgccactggtggttggcatggccagctttttattctcttatttggccccgcccatgtcctgctgatttgtccattttacagagtgctgatttgtccattttacagagtgctgattagtccattttacagagtgctgattggtgcatttttacagagtgctgattggtgcatttagaatcctttagctggacacggagcgctgattggtgcgtttttacagagtgctgatggatgcatttacaagcctttagctagacacagagcgctggttggtgcgtttttacagagtgctgattggtgcatttagaatcctttagctagacacagagcgctgattggtgcgtttttacagagtgatgatgggtgcatttacaagcctttagctagacacaaaagttcttcaagtccccactcagcccaggaagtccagctggcttcacctctcaaaatgatataggtttgggggaacttttaaaaatttgggcagattattttttggcagttattttttgttgctatgttttatcttcacgtgtttgtgtgtgtgtttgtgtatttcttaagaatactcaaacttggctgggtgcagtggctcactcctgtaatcccagctctttgggaggtcaaggccagcagattgtttgaggctaggagtttgagaacagactgggagtatagtgaaaccctgtctctactaaaaatttaaaaaattatctgggtgtggtggcaatgcctgtagccttagctacttggaggctgaggcaggaggatcctttgagcccagaaggttgaggctgcactgagtcataattgtgccattgcaactctagcctgggtgacagagtttaaccctgtctctaaaagaaaaaaagaaagaaatgctcatgttcttggaataaattcatttttataaatttattcaaattagttatacaaaaaactatgaggaacatatgtctgtaagaaggttcatacaacctcattgaacatgattgctcctagtaggaacttaaatagataacataagacaacatcaataggattttaaggcagccatttacaattacaatctcattttaaggcagccattttaaggcagccatttacaattacaattacaatctcaaataataattttataaaatagaatattgtatattatttagaaaacaaattacacaaatgacttcaatttacattaaaactcatatgtacattggacatgcagtaagaatatgaataacttccaaattttctgcagcgagcctgtatcaatttaaaatcagaatttatgtgtatgtatttaaaatatatatttaacgtaattctaccatctgacctagtaattcctaatcatttaatgtcccatctaattctttactgttgagtaatttgatttccgatactgtaatttattaaaataatgaagaaaaaggaaaaatatgtactaacatgtaaatttcagcatgatatataagactagaaaattgaaacacaaaggaacaatagtcacggaatcgttaaatataataggatcgcagtttaatatacgagtatgaaaactcatatgttaagagagaaaaactggatacagctatatgtgtgtgcatctagatatagactaaaatatatttttaaaatcctatggctatgactagataaagggctagaagaaaatttttgtaagttttgacagtaattacttctggggagaggtgtttctgttttctctctattcttcatttccaaaattttctcctattatgttatataaatttatagcgaggaaaataaagatattttattaaatgtaatttcttaaagaaaatattttattttccttcttccattgacaagttctctaaggtaaattttttctgactcctcccagatcacgtgtccaccattttattttatctagggaatgacaacctcacttatgtcattttgaagtactgcattatatgatatttggggggaatggcctctcccttaaaacctttacctgcaagcttcctctggagtctttttgagtcagcacctccatctgtggtccaagatgaaaaaggatgtactaaatcaccttgacagtcgtctgtttgcattatatcatcagtccctgtcttatgtgtggatgcaacatttcttcaatccattctttgcctctcctaagtgcacacattctcaggcagaatggagaatcactttttgttttgctataaaacacacactgacttttgagacaccttcccagaatgtcccagcaagactattattaatttttaaacagagataggactcccaagaaggaaaaccaggccatggtttacttcgcataatttaactgcttaactcaaaatattttccctagagaccatcacggtagtgaaacttttcctattataccattcattgacaaatttgtaatcatgatgtatgtgtatatacttatagtatatatttaaaatgggcattctgaccttgtagtttataattacaggattaacaaggctgaaaggaaattatgtaaattaggaaataggacaagagtgagggacaaacctggaatgatgacaagcacagggaaagatggttaagggaaaaaaaaataacttcctcttttgctgatttccgtattgtctagagctagccatacttagaccagcaaataagccaatctttttctgatgtttactcagcattttctgaggctctcctagcaacaagagtgttgcagggtgctggtcctgagaaggccaagcacatgccccctttgtggaactcttggtcaaatggaaaaaccaagtccaagagtcaagcaaaaggccaagagttttgacagaatgctcacaggagtgtgttcaactttacctgggaaaaagaaaatgagcaagcagagagatatgactttgtcttagtgaatctgaccgttttcaagtaaaatgtatagcacatactttgtccagtttgaatggtgatatattgcaaattaaatgaattacttaaaggccactgtttatgatttaatctatgaaaaacgtccctccattgcatttctgcatacgttaggtacttctgtcagagcatcttattctgctagtttgtttacacttgtttctctctcttctgaactgagactttcaaatattatggtacaactatcagatgctgatatataatgcttagaaaatgtagatgaagtgggaaaacaaaaagtttcatatttggggtcttataaattgctcctgttttaaggaagatccaataatcaaacatacttacaccactttttgttgttgaattcaattggcataaaatgacaacacaaacacaattttaacatgattgaaattgttggatgatgaagtaggaaaaagtgttagggaagtccggaaaagtaaacctaaacctgcttaaggtaactggaaggaatggaagtggctgtcaaactgaagaaaagttttgtaaaaaaaaattacagagaaatccatattcccaaggtgatctctggattttgtccagaagactcaggcagctagccatcttgtgatgatcccaagaaattcgttcatgaactttttcttcttagagaggagaggatcacacatattcattttctatgaccagagctcagagatacaaacaaacactacgtccaattttatgtcagtagattgtctaaaatattcagagtctggatggataaaatattatattaccaacaaactaaaggacttgtgggtactccaacagcacgtgggcaattggaatgatatcctttttaacgtgactttagtaagtcttaaattgtgttagcagcataaatatgtgggaagtggtaggaagcagagaaaggaggacgcttgctggtagctgggtaggggcagggaagttgaggggcctccagacctcatttcagaaagtcattaggaatgtgtcactctgtaattggcctgcgtttctgggacccgtcagtatctgcctttttggatcaatgtgtgatttttgaggctgtgacagtcccgctctgagtgggttgcaggtgaagcacagttgccctgtcttacgaaagggagagggttggcaagaaaagtccatctgacattgtaaacagctaaatttatcaaggcaacccatttttcagctatacagaactgtatttctgtagctgttttttaaaaatattatctaataacctcctagatttttctcacttcctacctatggtgaaacatgtaaataaggagaacccaaaagcatctcagttcataacacgtttgatttttttgtttcttttctttggaaatgttcttgcatgaaccatttgcacaatgccaggataaagccagttcaaacagatgtgaattgctgacttgatcatgagaaaattagaaaaaagttacctaatgctagtgtaaaactggttagtgtgtgagggtgtgcttaaagaagcaggaaaattacacaagacgatatgagtaccccaccttggaatcttaacaggggaaaaagtctactcattaacatatgctttaaataatccaaaagattaaataataccatgataaaataacttacaattgcaaaaatgtatttttaaagtacaaaaataccagagaaaacatttttattgatctacgtaagccctattaaataaattattttgcagagacattatgcagtcattgggaaaatgggtttaaacttcagtcagactcagattcaagtcttagctctactgcactcttgttctatttcctaagcaacttaccaaaccttttggagtctcagtgttcttatctgtaaagtgctgataatataaatatctagcccacagagcggttgtgaggaacaaaggagaacacacataaagtacctgggttatagaaagtatgcaatgtatttgcgtcagtactgcttctaatagtactcagtgccactctccaaattccacaatatgcttaacactcaaacttatttgatgagaagatctatattttttctactataccacacctgtacttcacaatatttacattgtttaaaaaagcaaatgttggtctcattgatatttctatggctaactcatcatggaaatgttgaccatataaccttgtaatgtcttattaagaggaagtgggctttccaagggcaaatcaaagttttctgaaatacgaatgtattatgggtctctgaagcacatgggcattagggaaaacttcatcccaagatcctgaaatggattaggatcaatttgtgttaatcttgaagtaattgtctagcccagggaagttcctgttaagaactcacttaatgattgtggaagaaaagaaagaaaataaaagaaggaaagagggaaggaaggaaggaaggaaggaaggaagcaagggaggcagggagggagggagacagggagggagggaaggaaagaaggaaggaaggaagaagggatggagggaggaagtatcaataaattaattactagttataacacctgaggatcatcttcttgcgcaaattatttttaacgttctttagctacaggcaaagatcatcctcatcccaccacttttgtccaaaattgtagctgcatccttgttttattgtcaagctagccttaagacctcgttcctcccttctaaactattggccaattctttttttttatacttgaaaatgtgccctttatctaatacttattatagcaaatcatgtcgatctctaatggctctgagcagatgcgccctacttggtgcacttgttccactccttgatgcagagagactgtctctcttattttagccttttgcatttaatgctttatatttgccttctctcccacccctatggtccatggccccagtaagaaggcaatatccatgaattattcttctccagaacacaatactgcacaaataaacattttctgattttcaaaacatttgtgcatatatggatgatctgtgtgtgtgtgtgtgtgtgtgtgcattcaaagcacacagcatgatttctaacatacactatgagtgcataacttggtctatgcattgactcagatacaaaataataattcaggaaaaagaaaggtattcaagatgaagcaagataagccatcacactttgaccatcctcaagaagaaattcaacagggtaagtacaattagggatatggtatttcacgtgtggtggtccagcaggatgcagcccatgtgaacttactttcagcgcttgacagacattgtgagtgaaaattattttgatcaaagtcttaagttagatcgcacactaaatatggattcatctaggttacatggtagactgagaaatccattgaaaatttccgcccgagaaaaccagcttgaaaataatgtaagtcttgtcactcgaggagacttggacatattaaaagagtttgatgtggaagtttggaaagcacctataccaaactgaaatattgccaagattattaatgcatcactttgatgagccaagaatttccatctttccccatgggagggatgtctccaatagttggaggtggaaagagggcacagcttttattttaagaataaagaatttcaaaatgaagaaaagaattgcagctaggttttgacagagcctgttgagaagtggaggcaaacatgatgttttataaatgttggtattacaatcagatcacttttggtaggtgccttctgattgtctaattagtatgatgtcagctgggcttgagaatcatttcttttttttaaaaccatctgttttgtcataaaagtttctttagaagccatatgcaggcagagcatttatgcttttgttttttcaaagtgatcttctgtgttctttgtgtctacatcctgtggcataaatcgtagttttaaactatctaggaagaatgcaaggagtccagcagaagaaataaataaataattggccaattaaatcaattaattgaaaaatcagtgatcttggacacaagggaacacgtcacctttaactcgtgtcacaggaagaaattatgttttcaaaatggtgaggttttgaatcatattgccttctgagcctgaattttcctatttaaaaatgggagatttggtaaggaattaattaaactcacatataagaggacaatgcaggagaaactctatattataataaattatatattatagatgaagatattttataaagtcttaaatacaaaacaaatatcagttataacaattgtatatattttaatcattataataaacatttattaaccactagaaagcaagctagtatgagtcattaaaccacaattttctaccatttgttacttcaaaacttcttcccttgtcggtttcttgtacatgtttgctgaatgtgtacatacatgcatgcatacctcgtctttctcaagctagtgaggttaatgactataaaataacattttattttccctttactttaaacttttcccagcataaatctgtcagtcaagtactcctgcctctcgcttgatcagaattacatggttgttcttgagtccttttgagatcccaagagtctggtgacatatttgtaagtcacaaggaattaagaggtcaagaacatcaatatcagttcaggaatgtacggatagagccctatgatcaagcaagaaacaccagctgtaagcaccattcaacgtacttagaacagttcaataaactctgatggatgatgaaaatttcaaaagcatactctacacaaggaacataaagcaatctttttggatagtcaatttcttggtagtaatagtagtagcgttaatgttatttctttacatttgttgagcacttgatgcttttctaagtgctttaaaacatgttatctcagaatgtttagtccccaccagtgcatcccaatttgcagatattaactttgagctatggcagcaaacagctcaagatctacattagctttcggtgtctaagaaatgcaaaacttcctcattcttcttaccatgtaattttccaacatatagggatatattagaagcctggagactcagcaacttgccatctcttacaaaattaatgatggagttagtatttgaacctgagtcttctgatcttttcaccagcatgggtgctgttcaggctcacactttggatcaccctgtgaggctgatgctggctgtctgtgaagcagcaggaggaagagaaacaacccacagcacagaaaacagtgctgctttgaagagtgggtcacaacacgattgccaggctgtgatgcatctcatcttgtaaaagtaaatacttggcgatttccttgtggattccaatagtttctcttgtcacacactgactataacagctgcattcgcttcatgaaaatgggttagagataataaattgaccgaaaatatagaagactgaagtttttgaaagcagtatctggaaacaaattgtttataaattttacctctagaattttgaactccagagcaactcaatttaaaatttggaacaacgataattaccaaagaattttccacagccttaaactagtatttcccaccaaaacagtgatacttaaaatgcatatgaagtaatttattttaggagtattgtgcatattatgcatacacacaaacttacactactatgtaactgagaaacaagaacttgacaaggtgcaggtcaggctaggggtgagaagttggagtgaggcagatacagtgcgactggaagggaacgcagtccagaacagaatcaggtgttgaaactatcaggaagcagtgaattccaactggcacaagtgttgttgttgttttttctcatctccgacttgaaaactgaagggacacacgagtcctttgatgattccttgagtgatccagatgtactgagctggggatgttttggaagagggaattttctgagtaaataataagggacaatatctttgtatcagatgtacataaatgtgataaacatgctttgaaagtgctgtagtcaaattcttaaattatgataaccgagaaaaaagttaagaaaaatggtatatgtataataatactatgttcagactccactgtttctgccattttttttgttgttattttatctattttttcttggtctccttcctttcttctccttcctttcttaacccttccttccttcttttgtctttctctctctctctcgctcactctcttcctctttttctttcttactggcagtctgagtggtaagacagtgctgtatatacagaactgtatcatagaagggaacctagaaattttctagttcagagttttctaaaatgcattttataataaattagttgtatgagatatttttagggggttctatgctaacaaactgaaagaaacatggtgttttatattcctccttagaccttcaccatatatattggcaaattaaagatgaaacattttgcaattaagataactacttaattttgttttatctatttatttccaaacttacactcaatgaccctaacttggataataccaaaagaacttaaggagctagctaccccaaatcactgttgggggaacagacgatttattctatcttgctactcactgcaggaataacatgtcagcactaatgacacatatttgtgaatatgtgttttgggtactgtcaggggctctgagcaataatgaaggaagaaccattcaacaggcacccttttatgggtcagattcgttcctttagtgggctcttttagagggttttattgttaatttcctaccaacacacttgctacaatatattgtataagaaattcataagttcctgggctaaggcatttggcctaactgtctaagccgggatgctgtctgacagatttttcacaaatttatcacactgagtcattgtaagggaattaggaccacaagagaccttctttttggtcctggttaggatctgaacatcagatttctgtttaggcacccagaactggttaatcaaatcataatgactgtattccatactgttattcatcggggaagcatatttatctgagtatcagataagctaccttttaattttttttaactgctatgatgtgccacttaaacgaatgccaagactttgtgcttacaaaccttctacccacaaagaatcctttatcttacctttgcataattgacttatttctaattaaatgtggtatagaaaaaaaaagacctacaaaatttcaacttctatcatttgttccttcctttaagtctctgtgcttctgtaaacatgttagaaccttgagcaatgcattgtccatgctgctagctcttcctttcagataggtttcatgatacattccaccaaccacaacacacacacactcacacacaaacacacaccatccagatctttattctatttcccgattaaatgttcagaaaggcagtgcaaggccaacatctaagtgtgcaactcaagacttctgtccaccttgatattattcagcatttttgagggacagttggtagttacactaactataaatctaccagactatatcatactccttcatcttgcccacaaggatatcatatgctctgctaaaaatcaagaaacactctatctaattcttccagtttaccaatttaataacactaccaaaggaggaacttgtactagtttggctcgtcttattattccaatccatgagagaaatttgtaataaatcttcattgttttatgtcatgacactcccggtattatttatgcaattctgttttcactgccaatgtttcatatcaagtaaaaatgttttcatatcaaataagcatatttgaccactatcaggctattggcatctctttatcttctgaaattttgcaaatattacctcataattattctgaatgctatttgcagcttgtccatttgtaaagaatttgtcattcaaaatattttaaaattttcatgtttgagaattaattcaactcataattcaattttatagttgtttaaaatcttctttgtaaaagaatatgctcagaatattacatcaagaaggcaggttggacacatacacctatcttgtgcctatctcacacaaatcactgaataatagaaatcatgcaaaaagtaaaaataaattgataatagtgttcacaaacaattagggggcagcaatcatcagacagaaaatcctgaaaatgtgttgcatatggaattagtttgctggagaaacaagagtaagccttcatttacatatggaaaaaaactatagaaaagggaaagtcaggttctgtaatatttgaattttgtgatcaacagatacaagacaagccctctggactggtgcttctcaaatgtcagcgacacacaaatcacatgggaaaggtgtttaaatacagtctgattagaaggtctggggtggtggccaagtgtctgctttgcatgttagacaatgctaacactgctggtccttaaacatttctttgaatatcaagggtcttgatcagaggctgtggggggcagagcccagcaatctgtttgttaacaagtcctccagggcattcagatacatgcttaaatgtggaccctctagtagttaagtgaacaggtgcattgagttcagctggcctgttacctacatttaccacatttccattccctcccctaatccaagctgcagggtccacaagtgttttctctgaggcttaaaaccctgtataactctggtctcagaagatattaatcaatgaccctgaggagggcttacagtgttgattcgttatctgaggtagaacaaagcaaatttggagattacctttatccttttaccatctacatgaaggaggaacaaagaaaaggcagttttgctgagggagaaaatctatccaagtgatccacccatgttaaagtgttttttattttggcatttgcctgacagggtctgaagcttgcctgccactttcccattcacgtttcttagaattagaatttatatggagcctatgtctactttcatacaatatatgaaaacacttaagttatcatttaaggtaaaaactattgattaaaatatgtttatcctcttatcttgataatgatgtgatggccaggtttatatttagaattttgtgctgcctggagttccacatttgaatgtggagctgtagggacagctccaacctggcctttaagctttcctcccctgatcaaccacccactccctttcttttcttttttttatcaatctacagcatttggactcaacattttgcaagtaagcatatcttagggatttgtgacaatcttttcagcaatagtagctcattagagtggcaatgctaaatgctgcctgtgggtggttagggcaacagaaggcatacctccccaaaatgacatattataatctccagggagacgtgtgaaatttgaaaaagcttccaagatgattgcctagttaccattttgggatttgaaatctttatatacgttatttccatgccctccttggttaagtctccagatggagtaattatttacaaatgtcaataatatttacttcaaatcttactatattaacaaaaatcataggcaacgttaaagcctcttgaacaaattctttcttccttatataaatcttgtgagtctccatcctggacaagtacttgtatatttttttcacatgtggggctgacactcagctgatatacaccacaaaaacttatttgttaaacaacattatgctttataaatctaaccatttagaaatgatacatgtatatcaagtttattatttttgaatattttattccagacacccaatcaaaaagaaatataaatttgaggttgggcgtggtggctcacgcctttaatcccagcactttgggaggctgaggcaggtggatcacttgatgtcaggggttcaagaccagcctgaccaacatgttgaaaccctgtctctactaaaaatgcaaaaattagccaggcgtggtggtgcacatctttaatcccagctacttgggaggctgaagcaggagaactgcatgaacccaggaggcggaggttgcagtgagctgagatcgcaccactgcactccagcctgggtgacagagtaagactccatctcaaaaaaaaaaaataaaataaaataaatatatatatatatatatatgtatatatatttgatatattaaaaaataaactatattaagaaaaacaaaatgaatacttttgtactcaatttcatcatataattatttgcatattaacttgagggtctttttataaagtaaaacaacagaaacaacgaagagctttttgaaaatttcccttttgttgcattccttctcgaggtagcaattatattaaattcaacatttcacagtgtatggatttttttctaatgccaccactggctggttttgagatttttctcattacccttgatatttttcaatttcattttaaagtacctagttgtgggctgagatttttctttttctttcttttttgagacagggtcttgctctctttcccaggctggagtgtagtggcacaaacaacctgggcaacagagccagacttcaacctcagcctcccagctcaagcaaccctcctgcctcaggaggcaagaagctggtacctcccaagaagctggtaccactgatgtctgccatcactcctggttaattgtttgtttttgtttttgtagagacagggacttactctgttgcccaggctgctctcaaactcctggcctcaggtgatcctcctgcctccacctcccaaagtgctgggattacaggtgtgagccactgttcccaggcctgatttattttattttaaaattacatgttttgagccaggcatggtggctcatgcctgtaattccagcactttgggaggctgaggtgtgtggatcacctgtggtcaggagtttgagacaagcctgaccaacatggtgaaacatcatctctactaaaaaaaaaaaaaaaaaaaaaaaaaattagccaggtgtggtggcgcatgcctgtaatcccagctactcaggaggctgaggcaagagaattgcttgaacctaggaggcagaggttacagtgagccaggatcacgccactgcactccatcctgggcaacacagtagactctgtctcaaaatttaaaaaataaataaatacataagataaaattacatgtttgggtactgttagtgtgttttttgattgaagaactcatatccgtttttaatcttacgaatactctgctatttttttcaaatattgctcatctgctattttttccgtttatttttgtgggattactgtgaagcatatgctatatcctctccttctgtcctaagtgttttgtatgatatatccctttgtccctctgactatggttataggtgagtttcccaggaccatttttctcttttcttttttctttccaacatgtattttaggtgcaggaggtacaggtgcagatttgttacatgagtaaattatgtgttgtgggagtttggtgtacagattactttgtcacccaagtaataagcatagtacccaataggtggttttgtgatcctcactctcctctcacttgccatcctcaagtaggccctggtgtctgtggctcccttctttgtgtccatgtgtattcaatgtttcactcccggtaccacctttcgatttacaaatttgtttttaaattgtatccagttatgatcatcccatctgatgcactttttaatttatattacaattacttaatactatatgtatactttttatttctatgatttgtttatgattctttttcataagacaagaaagttgctttggttgtttttgttttaaattaatattgaattcatcttattgagcactttaaacatcttccaaaatgtttgtcaatactagagttttattgacttttataagatacattttcttcctgtgtttgaaacatttgattccagtctcatttgatgagagtatattttatatttttctccttctgtctctctccctgcttacttttcttggtgctcatatatctttgtattgctgttggcaattgcctctcgtaacccctgagcagccactttataactgggttttatacggtagtgattctggggagggcagatcccttcccagaaccagcagaagtctgtcctcaactcatgaagtccccctccatgtcctctcttctccctatacctttaggttatttagagcggctctgtccaatcaggcagccactagccattgatgaatatgtaagttgaatatttagtcaacggaattaaataaaatgtaaaatgcagttttctattcacactagccaattgtgtctaatggctaccaggaagggcagctctcatgcatcttgacagacagttctatcggatggtgtgactctagagctataatcccaggtgtcgtttctttcttgttgttgttgttttttgtttgttccagcagctggtttttttttgtttttgttttttgtttgtttgtttgtttgtttttgagatggactctttctctgtcaccaggctggagtgctgtggcgcgatcttggctcactgcaacctcggcttcctgggttcaagcgattctcctgtctcagcctcctgagtagctgggactacaagtgtgcgccaccatccccagctgatttttgtatgttagtagagacggggtttaaccatgttgaccaggatggtctggatctcttgacctcatgatccccccgcctcggcctcccaaagtgctggaaccagcggctgtttaagcttggcttgttttctttgggatggatgagccacataccatgtcccactagttgcaagcagaaagccttactttatttccctgtttcattgaatcactttcagccctctgtttcttgcaggtcctaaataaagtccaagttcccattgtctgggtccagggcttttaaatccatggtaacaaaataactcactgctttgtttttctgttccttttctggtcttcaaatcagaagctgctgttatagttttcctttatattttaaccattgtaaataattatttggacccaagagattgctgaagaattgtgcatcttggccaagaagtaaatagtccattcacttttattgcagacttatattccattatattttgaacaacctatatttatttacacatactgattttatggccattttggctgcttccaatttttacaattaataagaatgctgccattaacatcttgcacttctgcacaagtatgcaagttcctttgttggacatatagcaagaaatggagctgccagatcataggatatgtgcacactaatcattgttttatattattcttcagaattgttgcagtgtttaatcactattcctcagtatttctcaagattaagaattgatttctggctgggctcagtggctcacacatgtaatcacagcactttgggaggccaaggcaggtgaatcctctcaggtcgggagttcgagactagcctgcccaacatggtaaaaccaagtctctaccaaaattacaaaaattagccaggcgtggtggcgcatgcctgtaatcccagctacttgggaggctgaggcaggagaattgcttgaacctaggaggaggaggttgcagtgagccgagatcgcacgactgcactccagcctgggcgacaagagcaagactccatctcaaaaaaaaaaaaaaaaaaaaaaaagaatttatttctgcaaatggtggatgtagaatgctatctgattttaatttcatttattcaattattagctcatatctttttcattttttatttttattttattttattttatttttattttatgacacaaatgggtcatttgtgtttcttccttggctgtttacctgttaatggcctttgcttatgatttttttactggtttttacaagttatacattcataaaagtaaaaacattttgtttatatgatttgcaatgatctttttactgccttgggctttcttttgaacttcggtgacttttgtttagaagtgttttgtgtttttattgagaagtcaaatacattatttacttatgttgctatgtttcacaggctgctctctaattattggcctcaattgatcctcttgcctcagtctcccaagttggtgggattacagtcctgagctattttgctcagcagattgattaattgattaattaattagagacagggtctcactctgtcacccaggctagaatgtggtcaccttatcatagctcactgcagcctcaaacttctgggctcaagtgatcttcctgccttagcctcctgagtagctaggactacaagtgtgtgcaaccatgtctggctattttattttttatttttatttttttagagatggagccctgccatgttgcccaggctggtctcaaattcctggcctcaagttttcctctcacctttgcctcctaaagtgctgggagtacatgcatgagccactatgcctggccatatttattcttaaataagaatgtttctgatttgtgtgttattcaatgtattattctctagcttaaatttttaaaaatatattcctcctatgtttaagttgtgtttttcatatttaagtatgtaatatatctggatttatctgtgtgtttgtgtgtgtgtgtgtgtgtgtgtgtgtgtgtgtgagatggtgcataatttaattatttggtccatatttatgattggtggtcctatgatcctttgtgtatgggttttcctttcccctctgacttcttccaatgctacttaagtattatactaattcccacatatgacgatttgatttcctctgttctctactattggtctgtttatcatatgatcaattttacaccatctttactgccattctttatgtcttatagggaaaatcctcttggatccccattgtgtatgtctgtaaagttttatttactttcacagcactctcatacttttgtattctaacttgtttttggatcacacacacctgcagacacatagacacacacatggaaattgcatttaatttgtaaataaatttgaaataaatgacattttacaatgcttttctttctattcaagaaaatgatatgcctccatatttctccatttatagaaatcttcttttagagctccttcatgaaattttataattctctccaaaagaatcctttgcaccattagttagtttcatttcacagtagttgtaactttggttgccattttgaatgggatttttaaaaaatattttcttctaaatatatgttattggaatagaggaaaaatagggattttatatattctataaagcaagattaataaagttcactattaaagagttttttaaaagattatactaaggttaaaaaataacaaaccatatctttcattattctgctggctaaaaatcaccaattaactgtctaattgaagtattgggagcagtatccttgatttgtttccgacgtgaaagggaaagcttgaaatattttcacattatgtaatagttacatagggctgtgaatctcaaaccttcgggtgcatcagaaacacgtggagggcttggttagcaaaaggttatgattctccatggccaacgcttccgaaggagtaaatctgagctgggtgcagataatttgtattccataacaagttctcaggagacgctgctgctggggatcagaaaagaaatgtggtgaagtgggcagagaggctggatgctcgcaatgggagtcagatggcaaagttaaagatgctggtcagggcagggctcactggagcctaagttgtcacctgagcaaggtcttgaggacatgagagcattaggcatgaagattcctggaggaggagcttcttaggcacgtggaacatgagaatattactgatgtgtctgagaaacttcaagagggccatagtggctggagtagtgtggttgataaagaattataaaagagtaatcccagcattttggaaggccaagacagacggatcagttgaggtcaggagtttatgaccaccccagccagcatgatgaaacttcatttctactaaaaatacaaaaattagccaggcatggtggcagatgcctataatcctagctactcgggaggctgaggcaggagaatcacttgaatcggggaggtggaggttgcagtgagccaagatcgtgccactgcattccagcctgggtgacagaatgagacttcatctcaaaaaaaaaaaaaaaaaaaaaaaaaaaatcataaaagacaggcaagagggctaatgggaggccaggaggactaccttaaaggatcatcgtaagcactctgtcttccattttaaatgacttggggatttgctctcaagagtaagataatttgatatgtttttaaaggatcatctgacttttaagagtaagcattaaagggccaggatagaaacatggagaccaagaaaggggttgttgcagtaatacagacaagatttgttgtcatggtggggagaagtgatcagatttcagtatggttaaaggtagaccttgaacttgactctcctaccattggataagggatgtgaaataaagaaaggagtcatggatgcttttggcctgagcaactcaaaaaagattgaaccccttcaaggaaactgagggtttcccttaaatgaggacactgcgtaaagaaaggaaactgttctcctaatgcactgggtgtggaaagtgctgaggatattccaaataatacaaatacagaggatttatcaagtgcatacatgggacttggtattttttatgaaagatttatttaaggactagggaccactgtggacctccttgtgaaaaacataaattgtattttgatatcgtctaatgttaaacccaagtttcttcacaatgctacctctctccctcaattatggaaacctatatgaccacactgaagtttgccatggattcaatttgtttattattctacctcttgattcttgctgccacaaaacagtagtcatttcaactctcatcattttttcctgaagatgtggatggatgccctgctgtcccagagacagacctgaaggagccgccatggttgtcatggtatgctgaatgtacaccatagggctcagtttccctgaggaattaaagtcattccatagtaatatgtatcacctttaacttatgataacaatccagtccagttaatttcatttactttttcattgacagttaaaatgatatgtattactatgtacaatctgatgttttgacatatacatgcaatatgctgtgactaaatctacataattaacatatgtatttcttcatgtagttatcatgttggtgctgagaacactttatatccactctcttaggatttatcaagaatacaatatattaactatactcaccatgttaaaaaaaaatgtggatggatgctccctcaacaaactgaactttcctttccacagtaagatgcctgctgtgagcagctgcagaaagcagctctgtttcagcaacaaagaaaagcatattgcagaactacccatacctcatgcttccgtgtcattttcctttgcatttatttttattattcctcaaaaaacagaaacaatgttttctgcttctgatgatcaaatatttatcttctataaacttgtactttatgcttttcagtttaactacaattacctttggttttccctgggtataaaatggatgataccttaatttaaaaatgaagttttcacacaagataagaaaattgcaaattctaaataaggattgatgtctgttgctaatagtctaacaagaaaaacatagtggtatatcagaggaaatatttttttaattagcaatgtatatagttctcatttaatgactaacttttaactatgtttgaatgaatttttccttgcccacctcatcagtggcacaccgccatgacacagagaaaagtccacatctattgattattaaaaagaaggtagtgaaaaatctattaactatgttttatattatttctgtgtattcttaaacacaaaaatgaaaaataaaaatcactccttttactacaaatgcttaatctttattttctaaataataaataggctagagatgttcatttcctatttccacccaccatcatcagcactatttagtttttaaatagactaaattttttttagtcaatctcaagaaaaaaagagtttaaagtcttgggtgtggctgggcgtggtggctcatacctgtaatcccagcaatttgggagactgcagtaggtggatcgcttgaggccaggagttcgagaccagcctgagcaacatggcaaaaccccatcgctaccaaaaaatacaaaacaattagccagctgtgatggcacacgcctgtagtcccaaccgctttggaggctgaggcacgtgagtcccttgaacccggaggcagaggttgcagtgagctgagatctcgccactgcactccaacctgggtgacaaagtcttggatgtgaatctcaactactttcagtggtgtctctgacaagttgtcatccctcctctgctggagtcctacagtgacagcaattgcactttattctagaacggtacattttattttgtggtttctatgattttcaaatacatatttacattctttgaacatcagtttctttaataaataggaaccaaaatgaaaatgttatagtgatgagacataaggtaatatatataaaatgtgtatcagtgctatcaggattgcaaatattctgtaaatattagttattattttaaacgaatttgtgtcaaatctttgccttgaagtgatacagtgtcactggaaggttaagatatgaacatactttgttagttcaaagtatcatagaccagtgtcttataaacaacagatttttttctcacagttctggaggctggaggttgaatttcaggtcaccatcatggttgtacctgttgaggggcctcctccaggctgcagactaccaacttctccttgtatcctcacatggcaaaaagacagggggctagctctctagcctcttcttataagtggataaatcacatttatgagggccctgtcctggtgacctaattgccttccaaaggccacacctccaaataccatcacactgaaaaatagagtttcaacatataaactttggaagaagacaaacattcattccataatacacacagaaaatgaacttgagattattttgatataaatgcgattctgtagaaataattttaaaaacccgagtgattgacagaataattaattatatagaaaacaacgacacgaagacctaaaggtatgtagagaatattttcagttttaatattcaggtaagttttttaattgggttgggttaagcatatacatatgtatacacacgtataacatacacatatctcatctatatagacacttccccgtgaacctagttgttttgcccccacacccaatccccacccactcacatatctaaatgtatctctgaatgcagatctgttaaggcaggtgggaaccttagagtgaatatagatcacttgtagccttctccacaaagcattagcactgagactcagcgtgcacacatttctacatggcaggtggccccatcgaggtcctgttaaaaagggtgcagatatagaggatgtacggtgccctgctgataagaactaaacagtgacccctgataaattaacgtttctttgtccaaaccaaaatgaggccctgactcatttcaggagaggcacttataattattgaggaaaggtgttaggaagaaatcacaggccctagagactctcaacaatctgtatcaataaagtctaataacatcataggaagcaaattaaggtggaaactgattgctgctgattgcaaaggtctttatacataatttaaatgatccataaagagcaactggtggactagtctccaaaataaattatcctgtaacaggaaattcaaatgttttgatcactagaatacaaatgataaaattacataatatgaaaacataattttaatatacattttactgaggaaagtggtttctatttaatcagtgaaaataagtttattaatatggaattgtatagtctttcattggaactagttatttactagttcttttattggttaatgtgagctaaacatcaaaccaaattctgtaccacttattcccaaagacaccgaatgatagagtggcagtaatcaaaataaagaaaaaaatacaataccttaaagatgtaggtgcattgaaattaagtaagctttacatctagaaacaattttggtctatctgaggcttgattctgagccctgagcttgtattatataaataattttttatagtgaaaagtgatcatgactttggaatactatgtaagcaatgttttgggcattatctgtttctctagtgggtccatccatccaggttcattggtttgcagaaaatatataaaatgaagcattggaaaagctttttttttttttttttttttttttttgagatggagtcttgctgtgtcgcccaggctagagtgcagtggcttgatcttggctcactgcaagctctgcctcccaggttcacgccatcctcctgcctcagcctcccaagtagctgggactacaggcacccgccaccacgcttggttaattttttgtatttttagtagagacagggtttcaccacgttagtagtagatcggggtcttgatctcctgacctcgtgatccgcctgcctcgacctcccaaagtgctgggattacaggcgtgagccaccacctgtggccggaaaagctttcacataatctccaagcacagcaggttttaagtaatctgagtgtacaggaatctctcaaccaaggggttcttgggcttctactgtaacactcccagtggcagagaccattgtgtttctgtatggttctattgaaaagtctttttttttttttaatagtgagccaatgtctctgtccttccatttccactcacctgtatgtcaaagcctcacaaaacaagcccaaactcagtgtcccaagacagctatcagctgtgggataataaccaccacaccctcttcccgaaaaggagactgactccagttattctattcactaacatattcctctgagtaattcattttcaatgtctctgttaaaggaagacatttaaaaaaataaaaataaagaggacgagatccacatatactagtctgctagctcctatctggtacacccactggctttaccctaatttcttcaactcaaatatctccctttctcccttcagcctaggagtgagatggtttcattctgttgtcaactcctgttttactttatcatcccttgcttagcttctgactctttcttcacctgtgcaatcaattgtctttattaaaagatacttgaagaggtttctgttgtggtttccgtataccaagaacacgatgatcatatttgtgattctgattacctattctttgaggttcaatgtctacttcttgtttaaagcaactgttagtattgacattaaaagttctactatataaattgacatctgtggacaaaagaaaagtgatttaaaagtttttcaatttttgacaatgaaaactcatggtcaaaaaggcctagacacaagtcacaactgcaaaccttatttgctttgcaacttgctcaaattattccaaatctccattttccatatttaaaataacaaaacaatgctgacttaacaacacagggtggaatatgtaggtaattatgtcaagtgtctagcacagaatctggaaaattgtaggcacttgataaacatgacttctgccgtttctacataaaatgatgtagattaattccaagagccccagtcacttcttatttacttctgacaaatgatttttttctaaagtactaattataaaattgactaatgatgttgtagcctagggaagttttagagtaggtcattaaagttgtaattgtagtgcaaatttttttagatcgaggtctggtaataaatcccccagaaacctttatataatgtagctttctttatttaaaaccaaggcacagaatgaaaaaactagagctttgtatcttcaaaaacgtttatgagctttataagtaatgagtaggcatggctctcttttgtgcaccagaccagggccattagaggaaatgagtgcccagaggggataaatcactctccccaaagtgcagtgaggaagtagtgaatgggagtgtgtatacctgtgcacatgcagttgtgtgagagtgagagtgtttgtggtggaggtgtgtgtattggaagtaatagtgtagattccaaaagaagatggatgcagaggtttgctattctagttttgataaatttaagacctctattatgtggaatgattaggggaaaaaccttttgctgttagtgttacaaaaacatgcatgagtgtttatgttctatagataaagatacataccttaatgtatgctatatagaatatatggtcaagccagctgatctgtaaacctgtgtgctcttagatccatgtcctggcccttcttctattctgttccctatttcagagcaccacatttcttaggctctcttgaccaacggctttgaggggagttggccagtaggaagcactaaatgtgaaggctctctatctttctgttttgtctgtttttctggttcacttccaacagcagctaggttcatctagggtttcagctcctgtctgatagacccattggttttactttagtctctgtgactcagacgtctccctttctcccttcagcctagggatgagaatggcttcatgctgttgccagtccctgttactttatcatcccctgcttagcttcttgccacttcttcagctgtgtagtcaattgcctttattaaattttctcatttcagatacttaaagaggtttctgttttctgggtataccaactcttgctttctcagtatatttaatattgagtgagcatatgaattgagagattaggatattagtacatattaaatctaaatctatattaaatatcactgtaattttcctttagacattttcagattgacttaactgtgccattaagtgactgtgggaaatcattaaactcgtggtcttactttaacctttatctgtacaataagtctaaaatgataggcttgacttacctcaaaagatagttaaggctgggcacagtggctcatgcctgtaatcctagcacttcgggaggccgaggtgggctgatcacctgaggtcaggggttcaagaccagcctggccaacatggcaaaaccccatctctactaaaaatacaaaaattagttgggtgtggtggcgcattcctgtaatctcagctacttgggaggctgaggcaggagaatcccttgaacccgggaggcagaggttgcagtgagctgagattgcgccactgcactccagcctgggtgactggtctcaaaaaaaaaacaaaactaacaaattaataataaaatggagcacttgagaaatatgcataacactgtgtaagtgctcaagagcaacaagagaaagagaaataaacataagtctccattgttggtttaatgttgaaatcaaatctaagctttaacatatgcttttcatgtgccctagaacaccgaggttgattcaacttcaatctctaaacctacaaaatagtggtaacaacatctccttctcaacagtgtcatgagggttactttacctaacctttgtaatgctctcagcacatggggattgcatagaatgggtcttcaaggaggttggttctttcttcatctattcctcagcaagatgtagaagttctttctgatagcactccctggtcaatttattcctaagtaaaacacatatataggagtattttatacatatatatatatatatatatatatatatatatcacccatcacttgattaactgaatctctctctctcttttagcagaaactaatcaccatgtatttattgagttcaagtcactgctcatctctgagattccatttcaacttgtcaaacactccagttaaatagtattcctctgaatttcactttgaatttactgtatatggatatctatttaatttttgccaacttacttgttccaggttgcattttgcttttttatttttatttatttgtttttgtttgtttgtttatttattttgaaacagagtttcacccttttttttttttttttttttttttttgagatggagtctccctctgtcacccaggctggagtgcagtagcgtgatctccgctcactgcaagctccacctcccaggttcacgccattcgtctgcctcagcctcccgagtagctgggactacaggtgccctccaccatgcccggctaattttttgtattttttttttttagtagaggcggtgtttcactatggtagccaggattgtctcgatcttctgacctcgtgatccgcctgcttcggcctcccaaaatgctgggattacaggcgtgagccaccgcgcccggccttgaaacagagtttcactcttgtcgcccaggctggagtgcaatggcacgatcttggctcactgcaacctccacctcccgggttctgtcaattctcctgcctcagcctttcgagtagctaggattacaggcaccctccgccacacctggctaatttttgtatttttagcagaggcgtggtttcacggtgttggtcaggctcgtctggaactcctgacctcaggtgatctgcccatctcagcctcccaaaatgctgggattacaggcgtgagctaccacacccagttcttatttgttttaataaaaggtcaacaattttatgcatatcactatttgagagaatatcccctacgttgccttctgtagcttacctatccttacacatgtgtttgtgtaatttgcccagtttccacatgacattcagatttagaatggtatgtctcattatgcaatcttgcccaagctagtgactttgatattgccacctctttttgaccttgctttgttacaagaaaaaaaaaaaaaaaatgggaggggacatgttacccaaactctagccagttgaattgtgctgactgctttccaaaagaacatatgttctcactggaaagattcagaaaaatttggcatcagggatggcatgtggaatttaggaataagtctttgctttttaagaggaagtatgaaatagaagaaagtacattgaatttagaaacagaacatgtggggcctggttgttgttcgaccccttatgccctttgatgtcttaggtaagtccctcatctttgttgaaacatgctctttattatttcttctatctccacaattccatggtattagaaaatgtttatatttgagacaaaacctgcacttgcatctatctgctttaatttgaatattatatttttgtgtctaagatacgctataatattgagcgattcttggtattgaaaatcaaaggaagatgagacattataaatgggtcatagtcaacaaagcaaagaatgtgcaacatttattaaaactatttgatccatcttatattgcatcatcattaagtgtattttttagttttaaaaatgcaaaaaaatatagatgtggtcataatgaaaagcaatcagttatggacctatttttctgctccaagcccccacccctaatctcctcattcacaccctgagctcaacacacacaggatagcttattaaatcacttcacttggggtttttctggttgttaatttcacatatataaatagcacactaagcctctatttcttgctttatctactttagatatggagcattgattttctactgataatgagaatgaaagtcatttactccgcaccccacttcttctgtctcctccctgactttatcattattctcagtttccaaagttggtcttcatgacacacctaattgaggataatagtatagttaagaaacagggcttactgtggaaagcagtttggagatttctcaaaggacttaaaactactgttcaacccacccgtcccactactagtatatatatatatttaagagaaaataaattgttctaccaaaagacccatgcacttgcatgtttatcacagcactattcacaacagcaaagacgtggaatcaacctaggtgctgatcaacagtggattggataagaaaaatgaggtaatatacatcatggaatactacacagccataaaaagaataaaattacatctttcacaaaacatggatgcagctagaggccattatcctaagcaaattagtataaaaacagaaaaacaaatattgcatgctctcacccatgaaaactgaacaatgggtttacatggacataaaaatggcaacaatagacactggggactactggagaggggaaggatggagaggggcaagggttgaaaaactaactattggatactatgcttcgtacctgggtaatggggtcgattgaaccccagaatctcagcatcatgcaaaatacccatgttacaaacgtgcatatgtacaccctgaatctaaaataaaagtttaaattatgagaaaacaaacagaaaatatatttgaaaaatatttgtatcattaacgtaaattcatgttgaaatgataaaacattttgccaataaaagtaattttaacttggaaaaaaaaatagaatgatagtctataaatgtgtgataattcctgaagcctttggaaaatacgataaattttaaaaataagatttaatgatttgtctttaaaaacataaatagtccaggcgtggtggctcacgcctgtaatcccagcactttgggaggccgaggtgggcagatcacttcaggtcaggagttcgagaccaaactggccaacatggtgaaaccccatctctaccaaaaatacaaaaattagccaggcatggtggcacacacctgtaatcccagctacttgggaggttgagacaggagaatcacttgaacctgggaggtggaggttgcagagagctgagatcacgccactgcactccagcctgggcgacagagcgagactccatctcaaaaaaaagtaaataaataaaaaaaatttaaaaaataaaagcataaatgaatgaattgatgaataagtaaatagcttagcttcagaaaaaaaaagaaaaaaaaacaagaaacaggaatttttgtataaaattaagattgctctagttatataattccctggttttcccccaacaaattttcaaacttacaataacaattatatttgactgagtgccaatttaaacctataggcctatgctactttttttttttttaagaccagacctccctttcatctcagtctgaggtacatgaggcttttaatatgaaatcactttccattcggtccaaagcttccttgttgctgatgaatgtcatacataatgaaagattatatccatttatcctcagcagtaaatcatttatcacacaagggggatatattattgtgaattctgatcaaagctgcccacttcctttagccggcagaaatgctgcaccctgttagttgattgtacaatatcctgggagaaatagggaaaattatgctgttgaatgagggtttggcaactctaggggtttctaaaatgccttgtagaaaaatcatgtttcatgtagaaccttctatgattcaggcatgtgagctgtaaaagtcttattttgccttcttcgcttaattaaatcagaaggctgtgggacttttttcagcttgctctgtgatgtctgcaaacagattcctgaatgacatcctgtggacactttgcccccttttttagagagacaataattattaccacttctttttgaagcatgctgagtggttttatcagttgtttgctaatgagctctgtctctcctttataatgtcaatcataaggatgccttttaaatacaacttatctcccagatttattttcttttcattcttcctgatcaaggtacgtactgttttgcttcagggaatcatctacacaacccaggcagagaaggctggcctctttgatctcttgtggataacacactctctccttctgagaacagagctttccaaaaaggacattaccaccctccagatgagtctcttcttgtgttttatctgtgattttaggttatcattgccctctgttacacgtctgtattcactgcttttcaaattcaatagcatgtaagagtctcagtattaaaattatcctgagtcaagtgagatacagaatgaagcaggaacaataggtcttttcttccttccttctctcttgggcttctggccagcatgctggtatggtttgttcagattttatgcaaagctttacctggcgattcaccaaatcaagtcagaaacctgcacctaacatttataaacaacatttcttcatttgatcatcaccttattcttgaagtagctttcagtgctttggctatttaagaagtcagtattgaaattcatattctacccttgcacactgtgtgagctcactatatcccttgtgtggtgtatagaggaagtataattttccccaagtgccttatccttaaaacaagagatagctaaattgatcagaacgggatatcgttataggaaaaattgtatacattaaactttaggtgtttctgttaatagttcctactactgtgactattcagattattgtattccaacataggtaaaattgatggatttagcaaataaaatacagtacacctgttcacatctgaatttcagataaacaatgaatgcatttttagtataagtatgtcccaaatattgcttctaggacacatacaagaaattgttgtttatctgaaattcagatttgaacaggtgtactgtattttacctggcaacactacatatagtagaattcacgttctagtctttgctagtctgtagatattacgttcccctacttggtaactcctgtgaactgaattgtactgcccctacactgctattcacacggtgaagccctaactcccaatgagactgtatttggagataggatctttaggggaaaattaaggttaaatgaggtcacaaggatggggccttaatcctgtagcactgtgggcttataaaaagagagaatctctcttaggtgaggactcagcaagaaggtggggtctgcaacccaaggagagagccctcatcaaaacccaataatgctgcacctgaatcttggactcctagtctccagaaatttgggaaaataaatatctgttgcctaagccacctggtctatggtattttgttacagcagcccaacctgatttatacagtaactttaggatgtcttactagggcacagttttatgtttcttgctgaactgagatctagcaagcatagtcattaccttagatatggtatggctgtgtccccacccaaatcttatcttgaattataacttccataattcccatgtcatgggagggacccagtgggaggtaattgaatcatgggggcgagtctttcccgtgcggttctcatggtaatgaatgggtctcacaagatctgatggttttataaatgggagttgccctgccctgcacaagctctctttttgcctgctgccattcatgtaagatgtgacttgctcctccttgccttctgccatgattgggagcctccccagccatgtggaactgtaagtccattaaacctcttttgtaaattgcccagtctcgggtatgtctttatcagcagagtgaaaatggactaatacattaaatttgttaccagtagagcgggaccctgctgaaaagataactgaaaatttggaaataactttggaactgggtaacaagcagaggttggaacagtttggagggctcagaactagaaaggaaaacacaggaaagtttggaacttcctagagacttgttgaatggctttgacaaaaatgctgatagtgatatgaacaataagttccaggctgaggtggtctcagatgaagatgagaaacttgttgggaactagagcaaagctgcctcttgttatgttttacaaagagactggtggcatttttccccttccctagatatttgtgcaactttgaacttgagagagataatgtagggtatctggtggaagaaatttccaagcagcaaagcattcaagaggtgacttgggtgctgttaaaggcattcagttttataagggaagcagagcataaaagttcagaaaatttgcagcctgacaatgtgatagaaaagaaaattcaattttctgaggagaaattcaagctggctgcagaaatttgcataagtaacaaggagccgaatgttaatccccaagacaatggggaaaatgtctccaaggtatgtcggagatcttcacggcagcccctcccatcacaggcctggaggcctaggagaaaaaaaaatggttttgtgggccaggcctagggcccctctgctatgtgcagtctagggacttggtgccctgcatcccagctgctccagccatgactaaaaggggccaaggtacagctcaggccatggcttcagagggtgcaagcaccaagccttggcttccatgtggtgttgagcctgcaggtacacaaaagtcaagaattgaggtttggaaacctctgcctagatttcagaggatgtatgcaaatgcctggatgtctgggcagaagtttgctgcaggggcaggatgctcatggagaacctctgctagggcagtgcagaagggaaatgtggggttgaggccttcacacagagtccctactggggcactgtctagtggagctgtgagaagagagccactgtcctccagaccccagaatggtagatccaccaattgcttgcactgtgcacctgaaaaagctgcagacactcaatggcagcccaagaaaacagctgggagggatgctgtactctgcaaaaccacagagatggagctgcccaagaccataggaacccacctctcacatcattgtgacccagatgagagacatggtgtcaaaggagatcattttggagctttaagatttgactgccctgctggattttggacttgcatgggacctgtagccccttcattttggccaatttctcccatttgaaacaactgtatttacccaatgcctgtgcccccagtgtatctaggaagtaactaatttggttttgattttacaggctcataggcagaaggtacttgcctcgtctcagatgagacgttggactgtggacttttgagttaatgctgaaatgagttaagactttgggggactgtagggaacgcatgatttgttttggttttgaaatgtgaggtcatgagatttcagagaggtcggggtggaataatatggtttggctgtgtccccacccaaatcccatcttgaattgtaactcctgcaattcccacatgtcatgggagggagccaatgggaggtaattgaatcgtggggtctggtctttcctatgctgttctcatgatactaaatgggtctcacaagatccgatggtttaaaaatgggagttgccctgcacaagctctctttttacctgctaccatccatgtaagatgcgacttgttcctccttgccttctgccatgattgtgagatctcctcagccatgtggaactgtaagtccattaaacctctttcttttgtaaatttcccagtcttgggtatgtctttatcagcagggtgaaaacagactaatacaacctttctagtctggacatgttagtcaattactcttctgattctgagcaagtagagacaactgaaggaatctcccaatggttgtcccttaaacgtcaaattctatgattggctaatttctcaattttgatcatatcataaatcagaacaataaagagaaatcatggggggtagatgtgacaatgaacccagcctactattggctgaaaaatattaaaggcactgatgggaacatttaattgagtagacaaatgggggagatagcctgactgtcctctgactttgctgttagcatctaaatctacctaaattattggatgtatttacaaggaataagggcagtgtttgtttgtgtgtgtgtgtgagggtgtgagtgtgtgtaaaggtacacagagcatgtactaaatcaagattcagtaaccccatttagaaaggagcacctgagacttctgagaggttaatcacaggcctccatcacccttctaagtggcagaattggagaccatcctgcagccaaagacatgccttttcctccataactgactacctacattgaaaactagaatctcacatttttcacaatagatcttttgtatactaagaaatcagtaacagtgcatttcctcaaattgacatgaagcaaaatttcatccatcttccaacaacctgtcattgttaccccctctaaaccttttcttcttcataagggcaattattattttattacctctggtatgatattaaaattatgaagactttcctccaaggggccaccatattactgtctcatttacattcttatactaaaaatagatttttttttataccagatgtggtaaaatcaaagctaagttagacagaatgggtgattcctcccacatagctgctctggagaacatcgctatgcaccctgaagtgtacagggtgttcatgcccatgttaggtattttagttttgttaatgaggtggtgaggttgaggtgaagctcatgactaagtagaggcagaaatctctataaagaccaaatgtttattcagactgatgtgagaactctttagcttctgattctccaagaacaaatgtgtcataattagaagtaaaaaattgatgtgaatgggttgctgtttcccaggtactaaaagtgaccaatgaagtgtacggctagctgctggacacaagtccctgatactcaaggcctggttgagaagaccttgtagttgagcaaactcatttgttattatattttttaactcatcaaacttgaacttgttctttttcttttccttttttgtggctcaaatagtgatgcatgcagcacaacacctggatttgggcaaatgattttaaattcacacgtaaaaaccatagcaattttatgatgaattggcctccatctacttctgaatttaaactttgctaaagggaaaatccctacattttcttttctttttttttttcctttttttttttttttgagacggagtctcgctctgtcacccaggctggagcgcagggggtcgatctcggccaatgcaagctctgcctcccaggttccagccattctcctgcctcagcctcccaggtagctgagactacaggtgcccaccaccgtgcctggctaattttttgtatttttagtagagacagggtttaactgtgttagccaggatggtctcgatctcctgaccttgtgatccacccgcctcagcctcccaaagttctgggattacaggtgtgagctaccgtgcctggccaatccctacattttcttaaaatttaagatataattccattagcaagaaacgtcagagtgacattttaagcaatgcttgcatcagacaaaaaatgtatgatgtatttgaaatctattgacaacacattggaaaaccttcaagagttctaaagcagccgttactctgaaatttaaaataatcccattttagattctttcaattatagttaagaggattttgtaaaggctgtacctgtagccagtctgtaggtaattttaataacaagtggttaacttaaagatcttcctgtgttaattagtgttcttttttaaataagaattattaattaaattctcaattcagcaaaagaaaccttattctttaatcaatgtcacaaaattctccatagtcaaacttagatctcagtttccgtgatgagtggctggggaaaggaatgcgttctcccaccattaataccttttgagccaataactctaggctgtagatccttagctagaaacgtttttgtccacccagaacacactttgcatttagactgaggcctcctttgaaattctggctcctacatttcctatctccttgacactgggcaattcagttttccttgctgagaatccatcctctgttttttgtttgttcattttggttttggttttggcttttaaatcgagggtagtctgcagtcaagaaatatcactggaagctgggtgcggtggctcacgtctgtaatcccagcactttgggaggctgaggcaggcggataacttgaggtcaggagttccagactagcctggccaacatggtgaaaccccatctctactaaaaatacaaaacttagccaggcatggtggcacatgcatgtagtcccagctactggggaggctgaggcaggagaattgcttgagcctgggaggtggaggttacagtgagccgagatcatgccactgcactccagcctgggttacagagagatactctgtctcaaaaaaaaaaaaaaaaaaaagaaaatgtcattagtctttgaccaatatttatccagtccttatccagccccagttcctagtaatcaccattctactctctgcttcagtgagttcaacttttttagattccacgtatacgtgataacgtggtatttgtctttctgtgcctggcttatttcacttaacataatgccttccagtttcattcatgttgtcacaaatgacagaatttcctttttttctctaaagctgaatagtattccattgtgtatatgtagataccatattttatttatctattcatctgttgatgaatgtttaggttgattccatttctgggctattgtgaatagtgttgatataagcgtaggaatgtaaatatctcttccacatactaattttatttcctttgtctatatatccagtagtgggactgcttaatcatatggtacttctattttaaattttctgaagaatcaccattctatgttccataatggctttactaatgacattcccaccagcagtgcacaggaggaataatttcaagaaatctactgcataatatagttatgactatagttaataacaatgtactatatacctaaaaaattgctaacagtagacattaagtgttctcaccacaaataacataaggtacaatataggttaatagcttgatttagccattccacattgaatacatatttcaaaacatcatgttttaaaacattaaaacatcatgttgtacattataaatatatataatttttatgtcataaaaaaagaaatgtcattatcattctttagtgacaattcacctgaagtcttcttacccatagttgatgagtgtcttttaaattataaagctcaggaagtatgcctttaaatcactaaccaatatctgtgatatggtttgcttaagaacatttttagattggagaataatttacaaatctaggtctttcatttttaaaataaatcatggtgttagttcatgatatttgggccatatttttaaatcctaatcctgggaaaggtggttaggtatatggcaatttatgtctccactgaatttccatacagaatgccagaaggtaccacagataaagcaagagctttaaggtcaatcacagctgagtttgtatgtagttcaagtacttactggctgtgtggttttggggtaatatacttaacctttctcaatctctgtttcttcagttgaaaagctgggattatgctttcaaattcaaataataataaaaactaacatttcttgaatgcttatcatgcaccacaggtattgtatcatttactcctaataataaatccagggggtggctactgttatctgcattttacaaataaagaaaggaggcacaaaaaggcagagcagccaggcttcaaaaccaggcagagctccagaccaccttgcctctcaaatgtaaacttgaaatgccagacgatctttccattttccccaaccaaggactgacactgaggctgaggagaattggcagaagagagagaagaatatctggagggtttgttcctttttcaaatcagcatttaatagccctgttaaattggcaggcgtgtatattactgaccatgtttctattttcctgtaacaccaaagagtaaaggccattttttttccctatgaataaaagttgtcacggtcaggaaataaaccatatagtttgtctacaaccatttcccttgtgaagctaattgattttggctagttaaaactttatgtctaaaatcaaggtccaaagaagaaagtatgtataccttctatagcatttataaagagaccaggcactatgcaggaattggagcaaacatttgaacatatttgtattcttcatatatttgtctctataaattatataaaatccatttttgtagatacagagtataagattcctaggcataaaaatgactaaaatgcaattgtatataatatcagctacctgcacttgtttttctccttcctaataccatctcatttttttggggggttgaaactgagaaacaaagatattaaataattttcctaaaatatacccatacaactaaatgggaaagccataatataaaccatccctcttaatcatcatgatattaataaggaagacaggtgctaagcaaccatatgttgactgggctatctatgtagataatcaagtccctgagaatgaggacagagtagaattggagagtgtgacagtgaagcaacaataacacctttcatcaatgagtaaatgaccaggaaatccacagatgtggagcaagagagtagcacagttctctcaatagaaccatgttagtgttgcttgtttttgtatctgtcttgttttgttttcctaacaagaggaagaaggagaaattgaagaatgatctggaaatgtaaggaggctgttgattacaactgggggttcaatttttcactcattgtcatattataagccgtaacttagttgttattcaggaaataggctgaaagacactggcagatgagaattgcagagatgggaatgctctgaagttagcagtgtggccaggtggccaggataatcacttttagctggccaaaagatgatcatttctgtgggaacatcagcaagtgagtgacctgaccattttaagtctcttccttagggtcctccacatccagcctgggtaatatgttgctcaatctgctttaccacaccaggcaaaacaagtattgaatttcaaccaatgatcacagatcttgtattgtctcatccttgctggtactgttcgcttttctctggctcaattgttgccttttaaaactctttacttaaaccagccactgggcttttccttggggacaatgtagaagaggaaaacaatgatagaagggggtgctttttatttcaggtacagctgggcaggtgggatggatcagggaaaagctccaaggatgtcaagagtagaaatagtgatgtctacctttgaaactacaaaactccctacacaaccaagtgattggagctttgaaagcaatgcggagtagaaaactaatagaatatcaacctagttaaggcaagatttgctgtggggaagggaaggtcctgagcctctatttggccctgaggcttatcaacctgatacttcagttgggctcagaaagactcctgccccctccccattccctccctcccattgtgagggaccaatctctcttattctgtgttttcttaccatctcttccaccacttacctgctctactctgctttgcacatggtctcctcaactatgcccttccctacagccttttaaatgtggaaaagaaacaaaacaaataacatgatcaagaacttaccggtttccaggccaagtgcagtggctcacacctgtaaacccaaacactttgggaggccaagacaggaggattgcttgaggccaggaatttgagaccaacttcggcaacctagcaaaacccccctctacaaaaaattaaaaaaaataactgagtatggtggtgcacaattgtagtttcagctactcaggaggctgaggctgtaggattccttgagtctaggaggtcaaggctgcagctagccactgcatgccagcctggacaacagagtaagactctgcctcaaaaaaaaaaagaaaaaaaaaagaagggaagggaagaaggaaggagggaggaaggaagaaagaaagaaagaaattcactggtttccaatgtaacaaatcctttatctcaaagtagatgtacacttagagttggagacttttttaaaaacaattacaatgtctcggctcttgtgaactgagtttgctgtatggttatgtcactgtggataatgattttctcatttttttacacaatgtttatcaactttggctgtgcttcctctcctgagcatgctccttgttttgtaaaacaactggggaacattgagatttttcatataatttctgtgatgccaggctcctaagggataaagaaatacaaagaacagtgactggacagattgagtggagctttgaaagcaatacagagtagaaagataatagaatatctactataatgacacatgcacaagtgtttttattgcaacactatttgcaatagcaaagactaggaaccaaccaaaatgcctatcaatgatagactggataaagaaaatgtggcccatatacaccatggaatactatgcagccataaaaaagaataagttcgtgtcctttgcagggacatggatgaagctagaatccatcattctcagtaagctatcacagaaacagaaaaccaaacaccacattatcactcataagtgggagttgaacaatgaaagcacatggacacagggaggggaacatcacacaccggggcctgtcagggggtgggtggctaggggagggatagcattagtacaaatacctaatgcatgtgaggtttaaaacctggatgtcgggttggtgggtgcagcaaaccaccatggcacatgtatacctatgtaacaaacctgcacattttgcacatgtatcccagaacttaaaataataaaaaaaagaaagataatagaatattaacctggttaaggcaagatttgtgttttttaaaacatatattccccattaaagactacacatgtacttcttaatgttattaactttgtcatgtattaagatgaacagaaaggcatttctattatatgaattttttcttattcttgtgtctttcaaaaagaaaaaagaaaataaaacaaacaaatacacactcaactctcccccaaaaaaccaaaacaaaaacaagcaatgcaataatatttctcaaaagatatgcttgacacactatcagaagttctgccaacttcaatctatgcactagaagtgcattgaaaacttttattctttgcttcttgtctttaatattgttgtaaattcaatccacttcactggcattacctgctagcaacattccatcttcacatttggatgagtgtgaacttatcaaggtgacatatgtgtgatttttaatggaaattttactttgtttttcttaaaactgggtgtcaattagcagtgactcgcctccttaacaaaggaacagggtttgctgcctgcccagccacacagcccctggggggcttcctagcctgggctaggctgctgcaacatcatcacactttattagttacagcacagagttatggaggcaggaggaaagtactcactatgcaattttcctgataccccatgaggcctgagcacctcaaggtgggttagcactcatggaaaatcagtttaagatgggaaaatttcaaacatctttccttattttctttcccacacacaaatagaataatgcattttaagtaacaaagaacacttaaaaagcaaaacaaaaacaaaaagacacttatccttaaaagccaccatctccttaggatattcctcttatattaaataaggatacaaagagtaaagtgtacttaaaatctctcacaaagattggaaataaaatcttcaaaaagtgaatgcatacaatagcacatacgtaggacgtaattcattattattgggaaatgaaaatgaaagcaccatggtacgataattctgaataagaacaagctaattacattagggcagctttcagaaaacaagaatttatttttttatgacaaatatgactcagtacaaagtacacaaagtattttctgactcttactgtgatatgcctactttatttcaagtaaaatatatgaatttttaaaaggttatgaaaatgtgtttatgctttaaaaaaatcatttcagtaacatgttggatatctggaatatccatatattggaggtctgtgttctcagtctacaaggaaaattgccaaatccactctagagtgccaggcttaaaaaggtgttgaagagagcctgcccgattacctgaattccaatttggctcacaatgaaagatagaaaaattacctagatgcatttcaatgttgcttctccccttgcaatagaccttatttaatagcttattacactcagaaaacaaagcatattttaaggaaagaactcacgacgcatggttcctgtctcttgacagaacggcctctttgaattcttttgtcaatttcatagatttctaacaagcagagaattgttttttaaatctgattttttttaatgccagcagcactatttcctcctcttaagtaggacagattcatcctttaagcaacaatggatgcttccctgctgaactcgagcatgacagattaagcttcgagcagaccagtaaatgccacctccccacttaacaaggctgttcagagccaggcgtctggggcctcgccgtatttgttcctggaatcactgtctgatgagccactgctgtccgaggtggccaagcagccctgattgagcgagctatgtgaagacccgacaggggcctggcagggcggcgggggcatgcctcctttttggtgcttccaggcaaattccttgcctccaaattgtgcccgcctcaggacagttggcttgtacaatgcctggcagaaagtagacactttgcacttgtttactgaatataaaagagaaaaatagagagagaaaaaatctgagtttagagatgcctttcagaccttgccggataaaatgctgttatttctggcaaagtggtgaggtgacactgacttggaagaataactaagaggttaaaaaaaaaaaagtaggactaacagtgaacaagctaataaaacacatggaaaccaaattagtggtagccaaaatcaataatagatccattatatttcaaaatatcttttataagaaaatggcacttggaatatgtttctaaatgccttttagagaccagtgtgttgcataaagaaaaatacacctgcatccagaattataattttaagaaccattatttagattgctgtgaggtatcttaaaatgcgattcaatttgctccttagatattgcatatcaaactataaaagcaaagctacattgttggctttctccctttttggcaaagaaatagaattgagaatctgcctgttgaggtcagaaacagactgaatcaaaaaatatgaaagcatgaatgtactgttctcacatttatgtaattgatggctattttacttgttgaaatcttaagtctttcacaaccacatgcgtatgtttgtcatttatccccttttctcaggtgcaaagaaggctaccaaggagtccgttgtgatcaatttctgccgaaaactgattccatcttatcggatccaagtaggtcaagcatttttcttctctctaatgcaatatataggcagcgtttattctgagcaatggttgttaactcagctgaaagctatatttcagtcttgtgtctctgaaagctgccaaggacagaagctgatggcagatgttgatgttcaaagcatcctcagagctggctcagtctaggtcttctctgacgatgaggcctggcttccggattccaccttgaacccctgctgggaactcccaacaacccgggcctccttagctttccttctgcccagccacgtaccacctcatttcaaaagcagggatctagaaaaataacagagcttattatttacctgaaataatgttatggaaactacagtattataccgcttcttacgctttggttgttaatttatgatagtattaaaccataccttactaaagtaagaaaacgtgtacgaaatcatgtaagaagttttcaagcagactttgaaaactccatttttggcaacactatttgcatatcagtgattactgtcctaaggacaaattattttttctccattcatggaagaagacaatttgcagactaaaaaatatggctagtcattagtttgtttgtatggtagtaaaagtaaccttttatgcttaaatgcccaattctagtcaaatgtgaaatgtttatctttaaagaattctctgttctttcaatagctgctagaattgaatcatgactaaaaaatggggattttcattgaatcagcgatttagtttagtgaggataatgataggcattttgcaattggaaaggccaagttatggttttctgaatatcatacatacgtaacacagacttcagtaaatattttgtactgactaaggacagaggtcgccctgcctgtgtctgtgcgttttgctgcataatgaacgtgtctaggcatcttccaacatcttttcaaaatgcatattttcatttccccctgaatttctagctacatttactcaagtaaatgcaaagttatttgaaagaaaaaggttttgtttaatttaatttaattctattttatcttgacgaagcaattcaccatacagtaactactctttctttgcaaatttagctttccttgagaaaagtgaaggttgccacagggatatctctatttcctgaaatgtgagacacagttctctgggaattacccaaagaggatggtattactggagtttttggtatcttatttatcaagtgatttggaccacttgctcaggtggcctctgaaagggtattcatggttatgatgtgagacatatctttggcatgttaggaaacttgcataaaataatgggcttgctgatttctttctttttctttctctctcttttttcctcacttttcctaatgtatctagtttttctctttttctttctctcttttttctgtttttatcccttctcttttcctatttatttcccttcattattttgtctcctttaatataatacttcttcccttcctccctctttcccttcctccctctttccctttccccctttcctcccttcctcccttcctctcttcctttcttctttctttcctttcttccttccttcctccctccctcccttctttcctgttttgctttcttttcatatgtggctgtggaatagctattcagtacaggttacaaagggcaaggtcttgcatatggtacaaagtgggtaaaaaaaacctctttaaacaatctaatcaaatgttaccagccatttagataccatagttcatcactgcaagagtggaggagggggtcaccataatgactattctctcctcgtagaacaaaatggtcccacggttacagtcactatccctgaaaacctatttcaatgtctattaaattgctattaaaattatagctgtgtgagccaggcacggtggttcatgcctataaacccagcactttgggaggcagagatgcttgaggtcaggagtttgagaccagcctggccaacatggtgaaaccctgtctctactaaaaatacaaaaattagcctggtatggtggcaagtgcctgtagtctcagctacctctggaggctgagagaggagaatcacttgaatccaggaggcaaagttgaagtgagccaagatcacgccactgtactccagcctgggtgacagagcaagactctgtctcaaaaaaaaaaaaaaaaaaaaaaaaaattatacctctctgaaatgtttctattaagtgaaactgcaagataaaaaattacttttatataaaattgcaaaaggaacatactttgccccaaatgtagaaaagaaatacactaaaatgttgtaaggacgtggaattttatgaaattgtttttctatttctccagttttctgtaaagtggtatatcattatgtgagtcaaaatgccagaatccttgaaatttaaaaagaaagaataagcatggagagcccatggatgagtccttgagacacagcttaaatggaaaagcattatgtcttgcattcatccatgcacacgtgcatttctttaggtaatcattaattcatttcatcagtattttctcagcatccaccaagagccacctaattggtcaggctctgttaatacaaaagtgtgcaaacaggatttaggccctgaggatcccgcagattagtgagggggaaaaacatgtggatatataaacatggggatgaatttggtgtaacatttacccttttccgacgttagcagatttgattcggcttccaggcctcaggctttcacttgagcaatggcaacagtaatacctataagcattattgttatcatatagatggacagagtcaatgccagataatgtcagcccacttcccttattcctcactataattgttactaatacgcgtttaaatgatacatgtgccaggcactgtgccaaaggctttacatggattattttattaaaccctcacaatcacagtttagtaaggagactgctgacaattgcccacattttatagatgagaaaattagacctcagggaagctaagtaaacttgctcaaggtcatacagctagttaatgctagagtttaacttccattccaaatgactccaggacctgagctcccaactgaagggcgctttcctccctcccctagaaccctcccttctctagttattttcaacaggacatttatcactctaaattccactgactgaaactcaatgacctgcggcaaacattattctaaggaacaatatttgcacaattttcatatcttaatgcagcaacttgagcttccatagagatttaaatccctaatgaaatttccttgtcaaaattcttgctgaaggattgtttaatttgctgctcatgatatcttcagaatgactgtatgctcaggaaataagcttccactcaactccctccctccattttttctcttctgtctcctctcttctctccattccatcttccttccttcctccctctctctcgtctgtccagtgcatacttttgctgagtgaaatccctattagcagggggtgagaaaccgctgctcttttattctctcccaggcaatgcaaagttagtcagaaatgtgtatcttttacattaaattttaaaaataaaatcttaaatgacctatatttaggaaaatggtgcaaggatgtcactgtgagagccttactggcttgagtgtcttagcagtggttcagagctgggtcctcagactgtttcaaaaactcatcccctctgctctcttttaaatcccaagaacctatagctaactccattcaggaacatatttacctatgaggatcaatcttataaagtgtgtcagtgacagtttttgtaaatatatctaatgcaccaatctgtcagattaatcaaaccctcctatggattcaatgtaccacaagtcgcattcagatcatgaggctgaatagcaagcaggagttcagaaagaatgtagtgagtgactcagactttggtcagagtcaagaggaagtgaccttctgtggaggagccggcatcagctactgtggcattcttgaagggcatatttctgcctcctgcctcctatgctgccagcgcactgagggatagcagcagtaagcttcccggaagctgacttgtagactcctgccctggttttccttccttactacccattcccacccagggtagttaccatcctcagccttgaagcacagttagatggagctgaactatgtgtcagtcagaactgtgagccagcgaaggtttttctccatctcccctctcatgagcacatgccaggctgagttcccatcaagatcctgacataatcaccagccaatggaagcatgggggatgctgcagagaacagactcagaacagaatcaaagaatgcagtggggtagagaagatgcccattggaagcaagggcacgcctcctcacacacagctggagacagccgtttctaccccaccctgtgcctttctctccctgtcagaatccagtacttagcatattcctggctgtgatggcaggcttgagtctgcaggctcaagctctggcaagcagtgtatacagcttaaacacttggagtcgtctagcccctccgtggaaggtaggagcatcacttccatcatgtattcatacgtgctgacttcgattcgcactttgtttctttgcatcttagaaacaggctctgttctcaaagcacctggaaagatgctaggagcctggtctggatgtgattcagaggaagactggtgaaaaatatgatatggatttagacttcccatcagcccactgggtttgtgtgcctcagctttccaggaagaaccacttcacaagtccctaaagaaaagaaaaaaacaatcttcggtagagtgtgttctagcaccagagagggcatcaggtaggaaaataaatttataaacacagccccacttccaaatggcctgcagagacaaccaaatcatgcccaagcttggtctccttcctcatgttcccagggattgtcattcccagtgcctagaccatcaggctcagagccaagtggtgcccctttgccatatgtgtcacagtgaaggaaaaaaaaattgagaacagcctgggaatgccaatgtagggccaggagcctgggtaggcatttgctaagcagacacaaggagattttcctgaagattattaacagaaagttttcccccaaaagacccatgttctgtattcttgcctttctcaattgtatttaatatataggaacatgtgttctgtgtgtcaacaattaggtgaaagggtgaaacaaaaggtgctctgaattggaagtcaaagggttttgttctaattctgtgaccacctgatctttgtggtgtggcctttggcaaagcacagtttatttggaccttggtttctttatctgtagaacaattccatgggcatccagcttaaagaaagtgatggccctcagcagagcaggctgtcttgcaagccattcagaaggggagttcagtgcaccaccaaactagtggatttcttcactcattcattcatttccccagataattaagcatatgtaacatataccatgctttggatccaaataataataatcacagatcctattgtcttaatccatttgggatgctatgaaaaaataccattaactgggtggcttataaacaacagaaatttatttctcactattgtgaatgctaggaagtcaagatcaaggtgctggcaggttcagtgtctgctgtgggcaattttctgatagagggtgcattctctgtttccttacattggaaggcatgacacaactctctgcgcctcttttggaagggcttgaatcctattcatgaggatttcttcttcccgatctatcacctcccaaaggcactgcctcttactagcaccacattaaggattaggtttccacataagaatttcggtgggacacaaactttcagaccatagcatctaccatcagtaaactcagtgtagttaactgtgtttattgacattgaattacagactacaaaggacgtaatgtctgcaagatattgaaatgttttcttccttcactcattcaaaatcttattaatagtttgacattggacaagttgcataacattaataaaccctggctttcttctttataaattaagatattctaatctgtaacatatatagctgttgctaggatgaaataaaatactccattcagagcatgtcatgcttgggacattgtgagagctcaataaatattatctattatcatcattattatttttgttgtttcaactgtcaccttgattagtacacagtgtacaaggcactgagacaggtgctactaaggattaaaaagcatgcagcctattacctggcctcgaatatctccagttgtactgaggaagtaaaaatgcatgaagaagtacaaatgaggacacacgaaagacatgattgctaaggaaatataaaaatggaggggcaataaaagttcacataaagtggaaggagagatctggtgttaggaaaggatttctctaggagagaagattgcagtgagctattcacacaggatgtgtatctgtgaactgttgtacaagctgcacactgcccgacttcactggtatcatttatgctagagtgtgaagggccttctgtggagggttgcaacttggtcctgggaaggacatttccatgaataaattagatagaggaaaaacagattcttgaggacacaaagcagaaactaattatcactttcccctggtctattaatccatacagatgaaagaatgtatcttccagactggcatctgctgggaatacttaagtctgctaagctactctgccttccaggagccataaaaacattgttagcagaatggatttatatgtaaaatctgtcactcttattaccgtttttctggcttgccatgagaaggagaaacagagaattatctgattttgaccatgtcaccatgaatctcacaaaacccattaattctgtcaggttgtatatttttatatatttgattgctaatatcttcaagtctttccttttaaattatatagacaccaatcttttaccaatcatgtatgcaaacacatgatttctagatactaggaaaataattttatttacaagaaaggaaaaatttcctatgggtacctgattcagagataaccactgataatcaattcgtgcatactactccacatattttctactttttctgtggcatacatatgtattcatttttatttgtttgtttggtttttagaggcagggtcttgctctgtcacccaggctggagtgcaatggcatgatcttggctcactgcagcctcaactttctgggctcaagtgagcttgcctcagcctcccaagtagctgggactacaaatgcctgccaccacactcaactactttttaaaaaaatgtttataaggacagggtcttgctatgttgcccaggctggtcttgaactcctggcctcaggagatcctcccatctcagtctcccaaagtgctgggattacaggcttgagccactgtgccagacttgtatttggttttaaccattatgttgaaagcaggcctcacagggccagagggaagcccacctgcccttgcctctctcagctagagtgtttgggtctgtctgcccagcttgctaactacagcttccctgttggccccggctcactgggggccactctacccactctacccgggaagaggattgttcttctgtcctcccagggggcctgttcagcaggtctgaagacagttcccaactggttctcggttctcctgtgtggtccacagctattccacaggacatgctcactatattgtatcattgtgccctgggagagctgggcattcaggagcctctgtcaccagactgtcaggatcaaagatgacacttcctctctgtcatctctcctctgtcctttttatagtttcaaagtcagagagggagatcaagtgttatggaatggttctagattatctaattatttcctttataaattctgcgtgtggtgttttgtctcacacttcattatctattattcattatattgacatcttaatcaaatctgaggtaccagaaattaaatattcataccttattacacaatatactcatttgccttacaaaattaggattggctggatgctcacgcttgtaatctcagcactttgggaagccatggtgtaagtactccttgagcccaggagttgaatatcagcctgggcagcataggaagaccttgtttctagacaaaaaaataaaataaaatagccaggcatggcggtatgcacctgtagtcccagctacttgggaggctgaagctggaggatcgcttgagctcaggagctcgaggctgctgtgagttgtgattgcgccactgcactccagcctgggtgatgtagtgagaccttttctcaattaataacaacaacaaaaaaaggaacaccatcaggattatactacctgtattttgtaacttctacttcccactcaatatattgtgagctttttcccacagaattttcttaattttatattcttttaaactattcttttatattcttttataaatattccttataatattataagaatttaacgtaaattattttaccagtcatctatgaagggctgtttagtgggtttccaattttgcctgcttacagtgattaacaaccattatgcgtaagtctctgtaccttgatgtccaaatgatttcttgaggataaattcctagattttgatatattttgataacttttcctccagaaagattatatctgtttacatttccgtgagtgaaaagtaaaattgattttacttttttctttaccaacactggatagtattaattgctacttgtacagggaaaattatataccactaatattttatattgtaccttgattgccagcaatattgaatccttttttcacttgtttattggtcagtttcatttgtacctttatgaatttttaattatttttctttgctcactttgaaatactataatatttcaatcttatttaaaagagtttgctattttgaggataacaaactattcactatcatataatttttccagattgctctttgatttattatttatgatattttttgaagcatacaaaagttttgccttttatggagtcaaatctattaggtattttttaaaaagtagttcatatgggctaatgctatccttagcctaagaatgaaatgaattaacagtaattaagctattcaattttattatatttctatctgaaatttatgttagtgtgtagttttatattaagagtaatatgtttaaaaacacatttaatttttccaacagaatttattcaatagtctgacatttcttgatgatttataaatataaattaattatataatatataattacacatatttggtgttgtctgtggactttctactctgcagataggggtaacaccatgagagtatttagttttaagagaattgtagtttacatttggtaagattatttcctcaatttaaaaatatataattggttaaatatgattcaaccatatattgatttgaacttgattacatatgcattttagaataatatgcttgaaaaacaaccaatatatgatattaaatacaatataggattcaaaacaacatgtatgttatgactagggtgaccatataacttatcatctaaactaggatatttggaaagtgaaaagcagagctatgaataattacactggaataaaaaatatgaggcaaaactatacactcacccaaatttgtaacataaacatgtatatacttaactacataggcttaaaaaaaacttgaaggcactgtattgcaaaatatggtaggattgcacaattttttcaatatcttttgtgtatctcccaattttctgcaacacatttatattgtatatattattatattatttatttttaattattattttaaatttaataaatattaaaagaatgacaataatgacaaatgcttttttgatgattactgccagggactgttctaagttttaacaaataatcctcacacagtgttgtaaggtagattaaatcaattcccactttaatgtgtggaaactgagaaaaataaagtaaataaataaatacataaataaataataaaataaataaaataatttgcccaaggatacacacttagtcaatggaagcactgaaattttaaacccattgggtatacagtctaaaaaaatagaacatgaagaagcagttacaaacattgagagaatcgctttcccatagagttataattatgattcctcacattgcttctcttcctttgagcatcattatttttgatgcaacttttcatactgttctgctgtattaggatttgtggtgtcttctaacaaattgcaatatgggttcctgtgtaaaacttgagggcttggagagaggagggttttatttagttttgtcttgacagttgcaacttcagttgcagtcggagtagggaaggctttgctgcaagccaccttgctgagacatgccctgaggtggtgctctgtgttcatttcctaagcagaaatttgctgttttgagacctccactctgctcatagcatgactccccagagagaaaatcctagcagtgtctctggtctctgcttatagggcacctacagctgaggttggtgtaagacaggtgtctcgtggccatggctacctgctcaagaaggtgtaaagcccaggacaaatgcctaagtttcaccactcgccctaccctctgctacctttgccctcatcctctccatgtgagcaatcttagtagggttcttatcactcctataaggtgtttggagcctgattctgctcaactctccatacagtttaattttatatacaagtttttgtagtgtatttctacctttactgtatttggcctgtcacttatatgtgaggatggtgcctccttctgagatttatccattgatgtagctccccctccacatcccatattcataattttttttcatggaaagcatatgtggggacagtcttttgtgagtattccaatggcctttttaactagaagtttccaaagggttcacttttgagtgagtagaaggaagcactgaaaaaaaaaaaaaaagatggaaaatggggccaagactacccgaagattaaaagcaaagaaacaataaccacaaaacccaattagccctcaatcaaaagggtccagcacattggagattactttcattctgccatccatagctttctgtgcttctttctcatagtccactttggataaatttcaatcacatctaataacatcacatgtgtcactagacagacacaaccactttctgcaaaattcagaggaaaaccataatcattttcaactctgttaactagactttcctaaatgaatctatttatttacattctatgcccaagagctacattttgaagataaatagcagaattacctatttcttttgatggtgttttacatgacactgatgttaggagacaaccaacacagtgctgtaccaagtaacacgcccatgatcctccttttcctgagacagctattttcatagaatatgatagagcaatttcaccaatgtgtgactgacatgaaatggaatggtttgagctattatcatctttatttctaatttggtactaccagcgtttcagtttttaatatagttttaaaaaattggacacatgaattataaataatatctcataatgtggattaagaacacaaacagagagaagcagaaaaactgactacattgttgacagtagtcagagacacagggttctgaattttctcttaagagaaacatctccttaggtccccttaggcccatatttcaagttccaacagagtttttcatggaatgaggacttaactgagtgccaaatttcatgctaggcctctgtctacacatccttatttattatttctgagttatagtaattttatggttgaggcaacagacattcagataaattaattcacctacaaaaataatcaatttgtaagaatttgaaatcaaatctgctgagtccacattttagccatcaaagggccttttgatatgggccaaccaaattttcttgcaataggaaactttttaatatttattttactttattttttcatgaggggtcaagagcaaaacattctccatcatttattgaaattaatatcttcattaagtgtcatgacaagaggtataattaaaaatgtaacttgaaatatgtcaaaagatggatgcataattagtacagtttggggtaaaatcattgcattaagcaaagcagtccaccgtatataacctaattcttgtacatgatacgcacttgacaaaactgtgaacaattaaaatgaatttttgatgatttgtttgatatgtggataaattttttagaaccagcactggatcttctgaattcctggctcccctaactatttttagtctctccttatgaataagctgtcagtggtcaattatactggttggtgtctccactgtctccattttcttgggaatcttgaaaagtcaatcccttagggaagttttgtttgagaattaaggtggaattgatctggcagataaacattagattcccactgtgctttaaaccatgagaaggttatcaaattttcagtttttcctgatttcttgtcttcacagaaaagctctgtgattatacatgcaggacatttttaaatattgggcataacccactttagttgtccaggaacacattccagatccaataggagtgctttgtggataatctgtaagtggtgttccttaattaagagtgagcaacagggaatttgtaaatcaaaaacacatccctatagtgtaagccaattcagctacaagtaacatttattaacaacctattctagttcatacaagaaaccttgccaggtacatgcacaaaagttctgtcatttaactcttacaagataaagtagctattagtatcctcatttttgaactatgtaaataagattagaaaaggaaaccctagatgaagaacatcatcaagacttattgtaagatataagaagaactaaattgagagataatagcatgacctaccatagaatacttttgtagaatggaattgttccttaaatatctattgctatagttccaaatacaatcctcagactatgtcttaaatgtttttcttagcttttgtttgtttgtttgtttcttgtgtatctaattatggaacttaatcaccagcttgttgaggacaaatatgctggatttggttaccactacatctcaagtgcctttcatgcttccattacatcaggcactcaggtaattttgattgaatgagtgaaagagagacttgtttaaggtaacatgttttactagctcccattttaaatgtggttttagtacacctactttaaaatttatttagtattcacccaatgtctatgactttgctaagaattatggataattaatacagtaacagtatattttattttattttaaaaacctattttaattgaatttaatttttaggatagtaatacattcacatggttcagtatcaaacagcataaagaggtttacaataaaatgtattctacccttatcccccatttacccagttcttctgtgataggcaatcaatgccgttaattccttgtaaatctttgtaaagctactgtataaacgtataagtaaaatgaacaaaaaatccccttatctctttttatataaataacagctcgtaatacacactgttccacatctcgctttttcatctagcaatgatctagctttttcatctaaaatgatcttcaagatcattttatttcagttcatacagaacattctaattctttttataattgtatacaattccattcattgcatatagcataatatgactgctatggtctgaatgttaatgttcccaccaaaaattcatatgttgaaacataattaccaatgtgatgacattaggaggtagattagatcatcagagtgaagtcctcatgaatgggattaatgaccttaaagaggctcaagagctgccttgcttcttccaccatgtgaggacacagcaagaagacgcagtataagtacaagggccttttacctgccagcactttgatcttggacttcccagcctttaggatcataataaatagatttctgttatttataaacgacccagtttatggtattttgttacagcaatccaaagggactcagaaaacgatgtaacaacccatctgtgaatttgcatttggtttatttgctgtttaaattatgctactttaagtagtatatagaataaatttctaaagtggaaaatgtgggtgaaatatatgtacctttatagacctttgggttctcctcattgtcatactactagaatggtaccaatttaaaatcttaaatcctctgttttccaaagcctctttgacatgacggtttgttttatgaaactatatttgtctttgtttaatcttagaagtgaagaatactaactcattcatttttaaatttaattctttttatgatgagtgacatgaaaacatctttttatattttaaaagttttttattttttctttcctgtgaagtctctttaatattcctccccagtgtgtaattcagttattggtgattttcttattgatttgtaggagctatttttatttaagggaaatgaggcctttgattatgacatgagattgaagtagtttttttcttttgatctttgcattttgtctttgattatgatagttcaggcacaacaggaaacttctttttcctttctttttttccatgcattcctcttttctccctccctccttctttctttcctctcttcatttctttgtttttccttccttctttctttctttcttttattcttttattagaataattcattttttaccattgtggctattgggttttgtttactacctttaaaaagttccaccgggagtggtggctcacacctgcaatcccagcactttgggaggctgaggtgggcagatcatgaggttaggagattgagaccatcctggccaacatggtgaaaccccgtctttactaaatatacaaaaattacctgggcatggtggcacatgcatgtaatcctagttctttgggaggttgaggcaggagaattgcttgagccagggagtcagaggttgcagtgagccaagatcatgcctctgcactccagcctggcaaaagagtgagactccatctcaaaaaaaaaaaaaaaagttccttctcactccaaatttattcactaatatttctatctaaaaattttaggaatgtaattatttcagtattttttccttaaatcttgaaatgaatccagacttcttttttcctagatgattacacagattcccaagatcatttaattagtaatattattagcagcatatttgtcagtattaaatcgtatttatttattaataatgtcatattcttataaatgaatgaaaagatacataatgaaatatttcacatttatttggttctatttctattctgttctatggatccatatatttgtacatcattataatattcttaattattagggttttattaaatatattaaaatatataaaaggagagcatacccttcgttagctgtcttccatatcccccaaaatttgtatttgggttttatgaactcatttctgtctcaccagtgattactaatatatacttaggagttgattgttacacttaaaggtagctatgatgaaacatgagttaatgaagcagaagaagccaggctacataatgagagaagattaaaataacagagaaaggggggaaaagaaaaaaaaaaaaagcagataaagattgctttgcttctggaaatggcaacccaactaactctcttatttttttcatagccaggaaagaaaacttactatcatttccaaatgacaagcctcaacccaatttaattagctttaccttgagatccagagaccaatcctgttctatgtagctttatttgactcctaacatcccttgatctttctattctgtggggtgtttcattatctaaagcaaatatatactacttaaacataaaaaattgtaacattatgaggggtgactcattactggtgtgtaatatcatggtaccagacattactaatatgtaaggagcatgagcagaaagacaccagcctgtgtatagccatagactactatgcttttaattgttttgagattgagtgtctcaagatctagataaatcagcaagatgaaagatgctgaacactgacatcttctttgtgccttgtgaaaagaaacaaatgacatctctgagctgcttagaaaagaattatacctgggatagtggtcaagagtggggagatatatctcaggagagtctcaggtagtttgagtttttttcctgttcccttcataacaaacatgattcacagcaaccattgtagtattatcagtaaacaaggctcctgtttacatggtgacctgaaatagaccctgtagccagacatatccatccttccttgttccaaacacacaaattttactatactgcctttgtagtcactaccattttccttcaatggagttactttcttcctgcagtaatctcatagtaatttgtacactcttctcaaacaatcaacctcaaaaggatctaccatttgttggacacctaatacttcttttgaacacttgatctcattttatctcagcctctctgcccaaaaaatcatctagattgatattactgctgtcatttttcaggctagatgctgaatcctatttctagctgaagcttaggccatagcttcacttcaggctgcagcagaataagggaagggaagaatctgagtcccctggcttccactggggtggggagtttcctcagagatagggagaattcttccaaccaaaggaaatttgggaaatattaggaaacaggattatctgctgagaaggacaaaaccattccactgtaaatcaattgattaatccacatacaaacaacaggttttcttgcacaggaaaaactctgacacatattttactttacttttgtccttaaggacctgatgataggcctaggtacaccatctacttcacatttttctaatcttcctgtttaatgtcgcaatcaaacaagaaaagaagcagctttacttgttccttgtaaaccatgttgtccctcagtgatgccagcatcttccactggctcatattgaccaatatttcatacaagtgttcttgcaccttgcagttgcacctagcatcttcctgatttacagtctcagaactcgctctgtagacaccttttttttttctaaactgaaaacgtaccgtttgttttccatcttcctgtaactcctctaagaaagcagatggtggatcagatctcaggccaaagttctctccagatatgggatataatccaagcaacctggtacctgggaactcatttttactcctgtgagctcttatccatcattctggacttcagcagctgctcttcagcgtctgtttattcttttctactgaactcccttctctttgacagaaagcgtggctacagaaaacattctgactaattctgtttggggtcagtcatgaataactttattccaacagcttccaatggcaggcaaatcctttcccggttttacatactaatgtaaaataattctcaaggataaatctatgcttaacatattcaaattaaactttccagtcagataatatattctccttaatgtgcccagtgtatgtagttcgtagtatacactaactgcaatctactgatttatttgattgtgcacctaaaatatacaagtagtacatttcacaagtaagtacaaattcttcttttcagagtggagaaagaaatatatggatcctgtcctcatggaacttatacagatgataactaacactagttactacttaatttaaaagtggtacaaagtaccaggaagtaaatgtccagaatgcaataatgatatgtaacagtgaaacaaactggaccttgttggagagaaggttttcaggaatatattcattcagtcattcattcaacacttgctgtgaaccaagcactactgtttttttttttttcttatttggaaaaaagctgcatatttcattgactcttctgaacaaaggtcattaatacaaaagcacttgtaagttgctttacctggggaaagtattttggtgatttttatctaggtgaagttttctgggctcaaaaatcttttcctaacaggttgattttaataacagtccaaactattccaaaacaaaacaaaactgttttcctctcttcctaaacagaaacaatggcatccggagctgaaaatagcgttaattacatgaaaagtttgtgatgcacaggatttgctctggagtatgaaaagtgtgtcttagacttatgtttatactcacataaaatgagcaaaaaacgatagtcctcttcaggaagagattatctgatgaaaatctgcaaagatacttcaatctttctatgtactggagagtttatgaagccccaaccactgttctaagtagtgagacactttaccactttttgtacacgtgttgggttggagagtgacagattgaaaataaatatggaaattactgaataaacttatcagacagtgataaggtaattcagtagagaatgattagattgctactttattctgagtttcactagagaagaaatatttaaactgagatctgaataacaagaaagaaaattcttcggggaaggagcattccatagggagaaaacatccatggaaaagaccttaagcctgggataaacctgatatgctcaaaacaaaataaaacatacacacaaaatgtcagaatgaatgatgcaatatattggatgaagaggaatgtgatcatatcattgtcatcctaatgacgacccctttgagagtgaaaggagatgatgctctgtataataataaccaggccacaagcaggcatgcagccccttctggttgaataattgagaaacgaaagtctgctagaaggagaggctcaataaatatttgttgaaggaaggaataattgctctcactctaatggaatttttttttaaatttcttaacaaattgatttaattaaatctagttctagatgtatttatattttaaaatattttaatttgggcatttttggcttgatttggtcagtgtctttgtttttagagctccagatggctccaaaatatttttgttctcagcctttctctatgttaatactatcagtgaggccaacttagacaggtgtcccatgtgaattgcaattatttcacctcaaatggtttgtcttaccctagtcaaaacaaagcagctttgatttactacagttgaggtagaagagagattgctgaaggttacaagcctgattctgcttttattgtgtcatttgaggttgacctttatgctccagtaacctccctgaatctgtgtttttccaagtgtctgtaatgctcagtgttgggcatagccctggatgacactttcagatgaggaagtctgctgaacatctggctaaaaagcaagttttggagagcattttaggacttaaaatataaagtctaacagttttctgtattataaatgaccagatcagcatctatagatgtatttttatgagtaataaagtataaggggaaaggcttgcagagagaaaaagcaaggaagagaagtatgtcaatgaatacaaattctctcatttgataagaaaatgtaaaattatgaataaatgtatgacatctcattgcaagatatgataagactcaatttcccctgtttattgtcaccgaatatctaggaaacaaaaattttcaggacttcagtattttagcaggaagaaatctagtgactatagattgcctacccctcaccatctcaccagtgaaggtcttggtcagtagtctgtagctctccattttctgccccctaaatgtgtcttgcagtgagtggtcagtggtcaaatgaatggaacagtagaggcacttctatatcagcatgaaaaaccagtgaaatgctgtcttgccaatactgtgtatacagagagacatttataaaataataagcaggtaaaacttgtcttggcaaaaggctggctcattacattcagtgaatgttaaaaaaaaaaaaaagtcctctgtggtgataagtaaaatagaccatcaccacccaaatcaagccacattaacatcttgaactgctatgctttggatatggtttgtccctgccaaaactcatgttgaaatttgatccccaatggggcagtgttgggaggtaggacctagtgagagatgtttgggccatgggggcagatctgtcatgaagagattaatgtcctcttacaagtaagttctccatctaaagggaatgggttagtctggtgttaaaaggagcctggctttcttggtctctctctctctctctcttacttcctctcttactacgcaatctgtttgcatatgcctactcccattctactttctgccttaaattgaagcagcatgaggccctcaccagatgcagctgatacatgctgagagtaaattaaaccttccagtcaccagaattgttagccaaataaacctcttttgtttgtagaaaatcttgaactttccagtcaccagaattgttagccaaataaacctcttttctttgtagattgcccagactcaaaaattcttttataacaactctaaacagagacattaaccaacagcaggagttaatgaaaccaaaagtatgtcatgaggacagaaaatgtcaaatattttaccaaaatctttgggaagtctttcaaatgtcaaaccaatcacatcactgagatcctgcacatagagctcctggttacctcttgacacaggtagcaccctctaaagtgagagcaccagtggtgatatccttagccaaagtgatgagaagttgtatgttccagcaaaagtagcataacacaaaaacatacaagtgtttgagacaaagaagactcttaaccagggttcctagctttcattgagaaaatcctctcaatacatccttatcactcaaaaaattgaaatccattataataataatcatactaatctattgatgaaataataagaaacagcggaaggaaggatggtaggtaacagtcggcacaagacacacaaagaggaaactctatgggttctgcatgcgtgagttgctgaaaatgagctttaaggttaaagccaggagtttggaattaatgtgtagcatgtgaaatataaaaaactccattcaatgccctcaattttatcagaggattagggtaacctcctggatacttgcagaaaaaagaaagccagcaataagcatttggctgtggcttggaggtttaatttactctcagcatgtagcatgggaacctttttgcctgagttgagaaaatagcctataaactagcaccacaaccccagaaaaacacagggccccagtagagacaaacagaagaacttccaacagagatgcccacagccaaaagcacatctggtctctaaagaataactcatgatgctagtgatctcacaggaaaaattacaacaaagataagaaaaaagcatataagaaaatcttcataagagaattgtcagcagatgtagaaatcaatccagaatgcagccaaagagaaaacatgaacaatgtgtgaattaaaagcagataaatatagcataccaaataccaaggaagagaaaaacattactctgataattaatagcgaagcataatcatcaaaaaggcaaagtaccactatcgtctctgtcatctaacttcatactgaagctttaagtaagcctaataacagaataagaaaaaagagaaagaacattacaaaatgaaataaaactatattattctgcattacagaggctatggttttatctacttagaaaataaaaaaataaataaatagagaatagctaccaaaactaaagaactaataaaatcagcatacagaagacagtcttacatacagacaactataactaattagaaaatataattttaacagattttttaataagaaatctattacattttctgattttattagtgtatgtacatggcaatggcatacataattaaatgtatattacaaatgtaaactaagtatatattgtaaaaaaattaaaaatatcatattcccaacagcttcaaatgttatataacgtagactctcaggagactaggtactcttagaactagaaaaaaaaattcaataaatagcactgaggaaattgggtgcccacatgaaaataattaaatgtatttcatatttttaaaaatctacagatgacttgagctaattataaaaaaaactctaaaactttgagaagaaaatatagaatattttatgatatatagcaaaaatgtaatattttcaaggaagaaagtaaaacatatcgaaaccaaagttaaagcaaactgacttctattttatcaaggcttatctaaaaacacaatagcaattcttcagaaatatctgtggaacccttctaaattaattataacctcactataataaaaaagtaatatcttcaagaaaataaggcatttttagagaccatttgtagccatagtgcaataaaacaagaagcaaaaacaaagtaacagaaaataacccaaatactttcctattccaacaaacaaaaaccaaaactcttctaaagaatccttagcttaaattggaatcaaagctgcaataacaaacattttgttagaaaataacagtagacaatcatcatttaaattctgttgataaagtgctcagcataaaaacctgagactgaattgctacttttcagtaaaaacaacataaaccagaagtcagaaataattttaagagaaggaaaatcaaaagtcaatgcatttgaaaaaataaaattaataaaatatataaaattaagaaataaatcagtttggcttgtaataattccagtaatggaatgaaataattatttagaaagcaaggaaaaacataaatggaatgcttctcagtattttcaaaataaaaaaattaagttaaaattataaaacatatatatgtgtatgcacaaatataaattgtatttttttctttttcctttttttcttctttcttcctttcttccttccgttctttcttctttctttctttctctttctttctttctttctttctttctttctttctttctttctttctttcttttctttctttcttctttcttttcctttctctctttctttctttcttttctttctttcttctttcttttcctttctctctttctttctttctttttttttgataggacctcactctgttgcctaggtgggagtgcagtggtgcaatcacagctcactgcagcctccgcctcgccagctaggtttttggattgtttgcagatatgggttttcaccatgttgcccaggctggtctcaaacttctgggctcaagcaatccacccaccttagactcccaaagtgctgggattacaggcatgagccaccacacccagccacaaatagaaattttccaatttccattatgaatgagaaaaatgaataaaacaagaattataaaattaaatttttcaaacgctaattaaaaatacttgaaaagtttaccagccccaatgtttatataattccatgccatttaaattactttaaagcataggccatacaatgcaaactcaattcattgaataagacacacaaatgatacatgaaatctgacagtgatagcaatacattgaatatataaatcaatttgaattatgaatagtaatgcagaaatgtggaaatcagttcttccgtatacatatatacatttgcatgcatgcctgtgtgtctgtgtatacttgattctaaggaatgaatgaaaataatagttaacaaaatagcctagactttattcaatgtattcaactcttgtcttcaatatattccactgagaatgttgtagttataacactatatcctgtaccaagctttccatgtcaactagctttttgtttagtcacgcatagtatgctgtggtttgaatgtgtgccccaaaacccatgttgaagttcagttgccatggtgatgatattaagagtcagggccgttaagaggtgattagtcctgagggctctgccctcatgaatggattaatgctgttattgtccatctcctctttaaaatgatgcatccaaaagtctctgaaatgcatttgatttgtataaagagttattgccaaactgcccttttcagtgacaacatttatacactaacaaacatggttttttgtgacacctgattcttgcccagtgtttatggggtacagtgatttcatgaaaagcacacctagctgaaatttggggaacaattgtttcatgtagaaagaatgaatcttagattgtattaaaattcaaatatgccatgacaaacagcgaccttttccagaggttttgtaataatcactcagcatgaggatgtcaattaataaatatgtgaaagcacattgataggccacaggaaaaattcatgtaaccatcctgaaatgcagaaagtattaaagaaatatccatttatccttaaagactcttagtaaaatatatttgaaaagtactttcctcatataatgaaagataattatctaaaataaattgacaaatatcaaaatagcaatagaattatagaggaattcctcttaaatttaaaacaaaacttagacttgtagcataaaacaaagaaaaataaaatttaaaaaactattttggattgctgaccaaattaataacaaataatcaaaataattaatatacgagtaaagaacattatcaatatgtgcagttttttgtacttggaaaccccaagataaatgagaaacaactttgaacacttcccatgttcaaaaaaaaaagtgactgactttgaaatcttcatacaaaaatcatttaatttataatgtcttatctgtccagtatggtggccattggtcatatgtggctgttgatcatacagaatgtgtctagtccaaattaagatgctctgcaagtaaaatatgtgtattagaattcaaagacttcatgtagaaaaaaagaaatgtaaaataactcattttactttttaatttttattagatgttgacatgataatatttggacatattgaatgaagtaaaatatgttaaaattaatccatctgtttctttttactcttttaatgtggatagtggaaaatttttaattgcatacatggcttgcatatgactcacattatatttcctttttctttttttttgagacagagtctcagtctgtcaccctgaagtacagtggagtggtcttggctcactgcaacttctgcctcccaggttcaagagatttttctgcttcatcctcctgagcacctgggaatacaggcatgcgccaccacacccaactactttttgtacttttagtggagatggggttttgccatgttgaccaggctggtctcgaactcgtagcctcaagtgatctgcccgcttcagctttctagagtgcttggattacaggtgtgagccaccagacccggcttcacattatatttctattaaaccacattgccctatgcaaatttttttttttttttttttttgagacttagtctcgctctgtcgcctaagtgcagtggtgcaatctcggctcactgcaacctgtgttcaagcgattctcctgcctcagcctcccgagtagctgagattacaggcacccaccgccacgcctggctaatttttgtatttttggtaaagacagggcttcaccatgttggccaggcaagtctcgaactcctgacctcaggtgatccgcccacctcagcctcccaaagtgctcccaaagtactcccaaagtacaggcatgagccaccacacccagccagcaaataaaaaatttttaaaaaagataatatgatagggaaattatttctttttgtaaaagcagtgcaaagtcagtaaactctaggtataaaaatataagatagtataagatgctgcagcaactgtatgattaaaactatgaagctatgttttgggctgtgtgtgtgtgagacagagagagcaacagaaagagaggaaagaaaagagagagagagaaagacagagaagaaggttcctgccatgctccttatttgaaaatcatgtcatatgacaaagtgtagtttaaattatactgcctagaactctttattcagtatgatccaatatcaaattatcaatattataaagaaggaaatgcttgctaaagtgattggtaaattcaatacagttttcattaaaaatatattttggaaagggtttgaactattttaaaattcttcagaataaacacctgagaaaaccagaacaaaaaccagtacctatgaacaatagaaaataaagaagacattttaactaagtaagaaaataatgcattatttaatattgggctagctctctaaccatatggaaatgaaagtataaaattcaattatttttcttacaattcacacaaaataaattttagaggattaaagttttacatatgatacaatgacaaagtaatataagtaaaccaaacaatcaaaaatataatcttattggatggaaagcatacttacacatgatacaaatgttagaattattatagaaatgattataaataaacagaaagtgaaatgggataagttgttcaacctcactgtagcgaagaaaatgcaaactaaaggatgctaattactcagaaattgaaatttatcaccattcattaaattaacactattttccaggagaagtgacaaataccaaaggtaggaatataggaatgaagatgttataaagaaaaaagccataacaaacaatcaattcagtaattcattttacttttctcttttcctcatgcaagttccctttgatggaaaattattgttggaggaatgtggtatcctgatccaaaatgataataatgtggtatgcatataactatttactttcttgtaatgtgtagcaaggtttgtagactgaattttagtttgtggaatgaataaatatcatctatatgaacatgattttttgaattattttgaaatgtcagctcttaactgacatagcaagtcatctctaagtaataaaatttaatatcagatttgatttccactcagaatttgtgtgtttaaggttttcattgcaaaaaagataatatagctttgcagaagttagacagttatttcctattcaattgctttgatgtgcctatttctttgaacaaaatctctttttaaatgctcttttgatatgtgagctcatggttgctctgaaattaatcccaaatgcaaaatgctcgtgaagaatttagagtttgctaaaagtagttattttgatacatttgttgatattttcttgatagggaatgaaccataatttactttaattatttttacgtgtgaatgtacgaaagtaaacagcagcaaccaccactttctaaagcagaaagtattttgtggccaggttttctcttggctcttaggagggccttctcgtctttattgtgatgctgacatgtgatacagacaatgaagactgaagtggtcagcctgaacaataacaaaaatgaccacaactagtcacagacttagaaaacacttctttcacacttttgtctataaagatctgcttatattgaatggaaatgaaccctaaaaatagtctagtttaaggataaggatcacattttataatttgcttgaggttggttgggctagtagctaatttaaatataggtctaaatgttctagtataacattgtttctcttatcctttctgtggtcttgctagtggggatggagtgtgggtagagttatcttgtagttcagctattagaaaactgtttcttcttcatcccagaataaatcttctacatcaagtagtacgctgattaccttctgtaattaaagacaaaaatgtatacatgtatttcctatttcatcagtcagtttgactgatatctgactccttacttattaaatgaagatattagcatccttagtcttttttttaatctctcttccctaggcccttctgtcttcccatttctgttgtttgttaagaacacttaaatatagcgtcaccataaatatatttttcttaccttactcataggtatattttgaaatctagtactctacgaagactaatcaccttaatatgtggatatattgtggatatatatatatatgatatatataaatccttatatatatatataaggatgatatatataaatccttaatatgtggatacaatgatccattgtaaaatcaagtatgaaattttgattatatttcctttcagtatagcttcttggattgttggtccagctagcaactctattaattctctccctccaatactcacagtgaccagttatttcaccttgtctcctggagcacccatctatcacacaaacagataccttctcaatctgctgcctgcatgtcttcttgggatttatctgcactgtttgcctgggttgcgtacttcatttttggattttcttgctttcctgtttttaattttgtttttcctcctttggctaaataaggaccatatattccctgagtatttctagagtgtctgaaaaatgtctttattctatgctcacactaccaggatcttttagcatttttcttcacgggttcttttaatctagagattcctgttcatctgctctattaaatacactttattatggtctggatagttttcatctctacattttattttttcttttctgttttctcattcttaaatttctcttggttggctattggatctcctggattggttttcttaatcttattatcttaccttttcccagtctttgtccatttcttttatttattgagaaatgttcatatattcctagtcttttatttattctttttatcttaactataacactgtaaattccaagatatcagatgtctcctttcctcaggaatttccattacattttacaggtgaaatactttttttgaatgtctctaaggatattactgttggtaatataatattttcttattttctatgaattatctctgttctctctctctctctctctctctctcatcctctgttcatgtttaagagtaaagtatgaggagttctttgagaactctgcgtatgtccatagtgctcctcaccttggagcaggccttcattttaagatgcttgacttggagctggtgtcattttggaggcccccagataccagaatgtcactggagtcacactctctcaacagatggccttccaggctcctttctaaaggcggatgcctgaccactgactgttgcaagtcaagagtaggagaaatgtgtctaggagtacgtattgtatctgtccccctccccacttcatgtgttcagttccatgtctttctttcactttcacgtgtactaggcacgtttttagtctcagacttctctgtggttttactaggagagctgtctcacttctcagttgtgtcccacactgcatttttctccatcccagttcaatagttaccactcttccatggacatgtggccttcaagagtttatagaaactttttataccctgatggttctttatcaacctcttgtttgtcgtagtgacctatttttttatacttacatttatttggttcccatgaaggaaagaaaatagatgcatgtggttaatccctcatccttaggctagaagttaccccaagaaattttaatttccatgttaataacccacctagcaccaagtaattgtagagattttcatctcttcaagaaaacagataaaatatttgtctcatcttctggctttctgtatgcagtatataaaacatttttctttcactgatagcaattcatgttattaactattttaatgatataaaatatctcactttattttaagtaatttaattttatctctttcatctgattaagatagattttctagcttcttaagttgtttaatgcaaagacaaggcttttgacagaaaatccatgtcacagtctaggaaatagcttttttgtgtgtgtacctacatttctgacgttcaagtttgttcccaaatttaaactcaaccctcaagcaatttgatttttgaacaaaaagaaatgttatatgtgttctctttctatgtatttaagattctatacgctttaagaagcaattactaataaaactgagattctaacagtcaaaattgtcagtagttttatcatcatctttgtcagtctttgacgactacagatgaaaggctccaaattgtactagattatttgtaacattttaacccataaagaaaatggaaataaatagtttgtgaaatatggttatcattaccaacctatatgtttttgccattagaagtcattttaacttttagtacataacaactaggatattacataattctcatgtgacttctattctttttaccaccctagaatacctgaagcaccagttcaaaggctgagttgtacttacatattctaaatgtttccatagttcctgcaaatattgactgatatcttgagaaaatataccttcaagagtttaatcatttaccttaaattgaaaatttgtattttaatggattctgggctgaattatgactgtcgattttaaataactttaattacttgaatttaggaaaattaataacataatttcaatattaaaaaaatattttgagatatatttctcaagtataatttaagagtaaagcagttcttatcactgtgatatgtgtttaggatatgtgtgattcagattgctgattttaacaaataactattctgcacagtgaagtagaaagcaatagactaggattagaagactaaattttaaacctcagctgtgaaaaatcagaagtctaaaaattactagcacaagtcaaaaaatcaagcctttcttttctcctaagtgtggatttatgtaattcttcctacatatctttttttctctatctaaattgtataaatataaccaaatataacattttttgtgtacacgctcagacatgtatacctaatacagtgtttaagacctgcaagatttcattgatgaacaagttgctttgcttgatattaataaacttgccaatttaggacgtgatgcagacccagccctcatttctgtaaggattgaatcctgagtctgtaacttagccaatcataatgttattaaagtagaaatattctgtacttagtgtgggatataagtgtatataaagcaaccatgaactccacacctttaatgaatagaataaaaatgagtcattatattattcttatttatttagtttttacatgtactcttactctccattctgttttttaaatatgaaaatgaaatagcagcatgactatgcatagtatttcaactacaataaattataaaagtgaaaggcttacattttaatgattataataatttagaaaggcatttcaaaactttccattattttctattcaagtactttagtaaaatgggtgggtatatcaagaatcttagcagagtttacaagacactattcctggtgaagacccctctttccaaaaccctgttgtgaacaaagtcacgttcttactcacagctctattcttggaaacacattattttgcaaattcctaatacgacgattttctaaaaccgtcaacacaaacggacatcctagtttgtaccagaatatgtctccctcaggaggtggcttgggcttctctgccatggctgacagacattgtagaagcagagagtcctgagaaaaacagaaaagccctcagatcagaggaggaaagaaacaaacactaggaggtgttttggcaatttaaacatattccaggttaagcagcatcagaatggacaccagggtagaccataacctcagaagggcatagtagatatgatagaaatgtaggctgagattggagataagggctggcaggaaactcattgtcctccttggagctaagtggagcaaaaaatggaactctattttgggtgtcttggacaaggaacagaatactcaggagctctagggaaaaatggaattcgggtctcccctggggacatttatcagaatgaagagaaaaaataaacaggcagctgcatcctaaaggtatcaagtgagcctctggcatgaactccctgagagttggtttagcaaaagtagtaataatgtgcagatttgtgggacaaagctttttgaattaatgatccaaggatttatctctggctcctggatggtaatgaaagatcatgcaagtgtctcagtacaaccagctagggtgagttaggatgaagcaaagggtgccaggcagattaacattctggtataaatttgttatacttttatcaccttccttcttaaacaagttactaatcttggaaaaattagaaataatatgagataaaatttgacatgctcttaatgaactgatcaacttcaatgatctaatcgagtcatatgaatgaagtattctttttaacgttaaaaaatgaaatgttttcaagtgattaaaaatttaaaagaagacataaaataaagccagtattttattctataaccacctatgttgggatgtaaatcataggtactatagttgctgacaagggttccattctggtgtatggaaaggcatcccacagttatagtcaggctcatttactgtggactcgtgatgcccccagcagtctggctgatcttcagaagtgtggcaatctgttcttattccatgtaagtttgtctaccaagctggttgccgcagagggaaaaacattcttactgcttagaggaaaataaacttattcacttaattattcattcaacacttaccaaaattattaatacttaatcagtgctaagtcctggatgagctattcctcattcaatgaagaattgatgaatcactatgttataacattagtggctgacatcaaattgtccatctcaatagcacttcaagcaaacaaacaataaaagtgagctcattatttttttttcctcccaattctgtttcctttgacatttatatcaacattcactctgttgtctaaatcaattttggatttacctttgatttctccctcttacttaacactcatattcaaacaaatctttgtgctttatttattcttcatctaaaagtacttcaaaatctatttccttcttcattgtcatctcagtttaaactctaccatccttccacatgggattatgaatattgtctcccagccaacttctttgcctttctcttttgttgaattaacttttgatgtctactttttttcaaattttgaggtaagctaattttattcttttttaacataaattttattatgcatatttgaggtttataacgtgatgttatgggatacatacagagggtaaaatggttactctagtgaaacagattagcagatctatcatctaacatagttactctgtttatctgcttctaggagtcagaaaacatatagttacttttcattcattcattcattcattcattcattcattcataatctactcatttaatgagaattcttagtacaatacaattttattaatcatagttgtcatgttgcacattagatctctagacttgcttaatcctatatatctgtcactttgtgtcctttcctgtatctcccctttccccactcccttgtgcccttaataaccactgttttattctatatctctgtatatttgtcatcttttttttccaaatattccacatataattgagatcatgcaatatgttttctgtctgtgtttggcttatttcacttaacataaggtcttctggggtcatccatgtcgtaacaaatggcaacgtcttccttttaaagtattacccatggtttccagtttgcttccatatctttttttttttttttttttttgagatggtctcactctatcacccaggctggaatatactgatgtgatcatagttcattgcagcctcgacctcctgggctcaagcaacactctgacctcagcctcccaagtaggtgggggaacaaacatgtgccaccgtgaccaactaattttttattttttgtagagacaagatctccctatgttgctcaggatggtcttgaactcctaggctcaagtgatccttttacctcagcttcctgaagttctgggattatgatcatgagccaccctgcagagcctgtttccgtatcttggctattatgaataatgttacagtgaacatggagtgaagatatctttgtgaggtggcaatttcatctcctttatgtatatacctggaaatgagattgctgagtcatatggttgttctgtttttaatttctttagtaacctccatactgtttttgataatggctatactaatctacattcccgccaactgtgcactgggttcactttccaactgggttcaccttgccaacacttattgcttgtcttttaggtcatagccattctaccaggtgtgatgtgattatatcctagtgattttaatttgcatttccttgataataaatgaaaatgaggccaaaatgaaatgttgggcattgttatgtcttctttggagaaatgtctgtttaggtcctttgtcccttttttccttgggtcatttgattttcagctatcgggttgtaaatgatcttaataaattttggatattaatcccttatcagatatatagcttgcaaatattttttccacatttgtagattgccttttcattttgttgattgtttcatttgctgtgtagaagatttttagtttaatatagatccatttatttatttttgtttttgtagcttgaaatttactttttcctttccaatttggatgcttattgttattattttatcatcattattatcaattaattaattttcttatcttatatctcttgctagcacttccagtactatgttgaatagaagtggcaagagtgggcatctctgccttgtaccagatcttgatagaaaagtttacagttgttccctattgattataatgttagctgtgagattttcattaatagcttttattatatggagaaacttttcttctgtaccaaaactgttatgtgtttttatcaagaaaagatactgaactttgtgacactttttttctgcagctgttgagctgatcatgcttttatttttcattctgttaatgtgatatatcacagtgactgatttgcatatattaaactggctttgcatgccagggatatatcacacttggtcatcatgtataatttttttgacgtgttgctaaattagttttgctagtgtttcattgagtattgttacattaatgttcattagacataatttttttgctgtgttgctgaattagttttgctagtgttttattgagtatttttacactaatgttcattagacatattgacttccagttttcttttcctgtgggatctttctctagcttaagtagaaaggtaattctagccttgtaagatgtttttggaacatcccattattttgggaaagagtttgagaaggattggcaataattatttgaatatttggcagaattcaaccatgaagtaatctggctctaggcttttctttgtttaaaagtttttaatgtcttcttcaacctctttattgtattattggtttgtttaagcttcctattttgtgttgattcaatcttggtaggctgtattttttttctagaaatttgttcatttcctctaggttatcaatatgttaacatataattgttcacaatagccgattatgatccttcttttttatttctgaggcatctgttataaggtcttcactttcatttctattttatgtacttgagtcttcactctttttttcttagtctagttagatgttttttgattttgtttactttttcaaagaaacaactcttggttttattgatttttttgttttatttttctgttctctatttgatttatgttctgatcctttttattccccagttttattttcctttttcttttttctttttttttttttttttttttgagatggagtcttactctgtcgtccaggctgttaatgtggcatgatctcagctcactgcaacctctgcctcctggtttcaagcgattcttgtgcatgcctcagcctcctgagtagctgggattataggtgcttgccaccatgccaggctaatttttgtatttttagtagagacagagttttgccatgttggccaggctggtcttgaactcctgacctcaagtgatctgctgcctcagcctctcaaagtgctgggattataggtgtgagccaccgtgcccagcctattatttcatttcttctgataaatttgggtttagtttcgcttcttcactggttcctagaggcataatatagggctatatatttgggatcttttttttttttttaagtaggcatttcttgctataaagattcctctagaactgcttttgctatatcccataggtttttatatgttgtgtttctattgtcatttgactcaataattttttgttaaattctcttttgatttgttctttgaccaattggttgttcatgagcatgttgtttaaattctttatatttgtgaatttaccaagattccttctgttattgatatctagtttcatatacttatagttcaaaataatactagatatgatttctatctactcaaattttttaatacttgttttgtggcatatatggtgcattctggggaatgttccatgtgcacaagagaagaatgtatattctgctgttgttgtatggaaacttttatacatgtctattaggtcaatttggtcaaaattgcatttcaagttctatattttctcattgattttctaactggctgatctattattaatagtgaggtattggcatccactagtattattatactgttgaaagtgaggtattgaagttccctactattattgtattgttatctatttattattttatgttcattaatattggctttatgtgtttaggtgctttagtgttacccactcccctacaatttatacttttgttgtcacaatttacatctttttatcatatatttcttaatagcttattgtagctataattgtgaccattttgacttttaaccttcatagtagacacttgaaatatttacacattgtcattgcagtaatggaatattctgaattttactataaatttatttctatcagtgagttttatacttttatatatttccattatagtaattataatccttttatttccaattgaaaagctaaacattttttgtaaggcagttctattggtgatacatcttctgacattttgcatatctgaaataatttgtttctccttcatttttgaagaacagctttattggctataccattttaggttggcagttttcttctttcagcactttgactatcttatctcattcttttctgacctgtgatatttctgctgagaaatcactgatgatctgatggggattcccttttatgtcacttgacattttcctcttgctgattttccaattttctctttgtctttgacttttgacattttgattataatatgcctcagtgagcacccctttggtagaatatgcttgaagacttttgagcttcatggatctgtatgttcatatctctcacccaacttgggaagtctttagctattattttgtcaaataagctttatgtgcctttttccatctctttaccctctgaaactctcataatctgaatatttattcacttaatggtgtttaataagtcccatagactttctttttcttcactctttttcattttttttctctccgggttattttaaaagatctgttttcaagttcagacagactttttgctgcttgatctagtctgctgttgactcttacatgtacttcttatttcattcaccaccttcttcaactcgcgtatttctgtttggtcctttcttatatctatctctttcttaaatttcacaatcagattatgaattattttcttgatcttactgaattgtctatctgtatcctcttgtatatcatgaattccctttatatgattatgtattcatcttcaggcaatttgtaattttcatttatatggggttagctactgaggaactgttgtgtttctttggtggtgtcatgttcccttgctttttcatgtttcttgtgtccctgtgttgatatctgtgcatctagaggaacagtaactacttttaattttatagattgttttttgtaggaaaaaactttcatttgcagatgggtcttagggtgtcatttggacagggtccattgcctccagttctgtgtgagtgcagtggtgtagcctttgtgtatcttcttcagctgtgatcaacattattgataactgcagttgcctcagtggtctacactgtaggagtttgtggcagcgtagtggcagggtaagttgtatggttcttggtgataagggctttaggggtcttcctgtttatgtttacccacagtagagagactcagctgaggggatccctcttgctgtctggtttgacatgtcccataggcagccatagtggtgctgtactacaagacacaggtactcagagtggctgtagagctgagggcctgggctcaatgtcttgtttcattactataacacctgtgacattgatgcaggttcattctctgaggtgcaggtgggtgctgcagtcccactaagctagggtggtgactcttaggcactcctcagtagcttgaaaccaagagaacagggaggtagttgtgactctggtcctggggatcaaggtgtaatactgacatagctctagggaagaattggtgttctacaggcttagtacttatggatccagccatagctgcaatttagatcctggaagcagtggaggacagagacattttgagcactgagagagggggtactgtgtagtggtggctccggaccctggagtgctaggacatagccgtggccaaagccctgcaaggttggctgcatcagcagcaataacccaggaatgttggggcacggctgtagcttggactccggggagtagggggcaatacaaaggtatcttcattgcccatggaggtgagatgcctcagcagttcagattccaaaaggcttgtacagattcagggaagcaaggtgctgaagctcttcagcccagaggacaaggtaacccagctcagccaaggctctttttccctggggggaagggtgcctgttaactcctgttccagggaatacagctgctctgctggactggggtccaagcattagattgcttcaggcactgagcgggtattgctgttcttccagcttggcaacagtgtctctgctgggtgggagcacatgattcttagggactgagtgctgcatgggcttggatgatggaattgtgactgatcctctggactaaagctcaaattcctgagggacaggacactgggttggtgtactagtccattctcaaactgctatgaagaaatccctaggactgggtaatttataaaggaaagaggtttaattgacttacagttctgcattgctggggaggcctcaggaaacttacaatcatggcagaaggcagaggagaagcagacaccttcttcacagggtggcaggatggagtgagtgcaagcaggcaaaatgccagaagcttataaaaccatcaggcctcacaaactcactcattatcatgaaaaaagcatgggggaaccgcccctacgatccaattacctccaccttgtccctcccttgacacatgaggattacaattcaagatgagattttgggtggggacacaaccaaatcatatcaattgatttaggtactgaggggctgtggctgctttctggctcaagtatggcttcttggctgggcaggagtgtctggtcctttggtggcagggcaccacatgggctcaggcactgaggttacactgctctgtggggtcaaaggctaaatttccgaggagtggggcagctggttggttcagttgctgggggagtagctgctctcctgagcctaggctctgtgtagacaggggtggagctcagcagtgactgggatgcgggggagggattctctcctaggcaatgtttcccaaggagaaggagctgcagcagtttaactggggtctggtacttttccctgtacgagaatgtggtgtaatggtagtagagtctcagggatgaaagaatgcagtggctacttgttcctggggcagggcatactctatcaagggctccggtttcaagattgtgatgcacagtagcagcacggaccacagggggtggggtgcaatgtgagatcttttagagtagtgcagccatgtgaactccaggaaacaccctaagctgggcttagaacctgtgaacactgcagggtttttcagtaacaaagattataggtatccactgtggtgatgaaggttgctaggggcctcctccttcctgtttccatcatggcagaaatacttcctgtttctgagctgattttagctgggggcatgagtggcagagtcaaggctttctcgtcttatctctatgcagcccttctgagtttctgtgatccacaggggctcttcacggacctactctacttcagtgctttcctttagttgctctgaccaaaatatagttattcatttgttgttttggtaactgttttggtggagagggatgagagttaggcacctctagtgagacatcttgatgatgtctcaaaaactctatcttcctattgttctattttcaagtttgctaattccttgtgacatattttttctgctaagttcctgccggaagttttattatgattattatatatttcatttccaaaattttaatttccttattcatgttttctatttctttagttactgaaattttctattctttttttttattatactttaagttctggggtacatgtgcagaaggtggaggtttgttacataggtatacatgtgccatggtggtttgctgcacccatcaacagtcatctacattaggtgtttctcctaatgttatccctcccctagccccccaccccccgacaggccccggtgtgatattctcctccctgtgtccaagtgttctcattgttcaactcccacttatgagtgagaacatgtggtgtttggttttctgttcttgcgttagtttgctgagaaagatggtttccagtttcatccatgttcctgcaaaggacatgaactcatcctttcttatggctgcatagtattccatggcgtatatgtgccacattttctttatccagtctatcattgatgggcatttgggttggttccaagtctttgctattgttaacagtgccacaataaacatatgtgtacatgtgtctttatgatagaatgatttataatcctttgggtatatacccagtaatgggattgctgggttaaatagtatttctagtactagatccttgaggatcaccacactgtcttccacaatggttgaactaatttacactcccacccacagtgtaaaagtgttcctatttctccacatcctctccagcatctgttgaggatatttgtatttgcttgttgaagaacttttgttgacaaataattctaacattctgtcatctcagcattgcgcctctttttttttttcttttctttttttttttttttttggtcaatcaagttgtgatttcctgtctcttgctatgacaagagctattttattatatcttgtacattttggctggtatgttgagagactctggatcctagttcagtcttttatttcaacaggcagttacactgtttagcttaaccatgtaaatactgatctaattttctggccaacagttttaatgacagtttaattttgagatactatttttatctgcttaattggcctgattctattaggtcttttgctaatccttcttggtgccaccagtgaggaccaaaagtgcttccccaggcagggttatctccattagctaggctctggaagagcacttttcctggccccttgttttctgtgggttctttcctgattcctgcctcagcattcaggcatcatgggttgctcagtgtctggtgtaagttgtaaaggttggggaactttagtttccaggcacttcccttggcctcttgtaggcaggattccatttcaataaagggaggaagggtcctgcctgagctgctttttcgtactgatttgggaattataagatgcccatgctgtatctctttgtgctggtgtgggagttggagcaagaactggaagatgttgaggcacagtgttttccttcaatcttgcaatccttaaccagtctaccttcctctttccacatctcagagtcctcctatggttgtctgttgtgttatctttaaggtttataattgtacgtagaggagaggaacaaggaatgatgagtctatgccatctcatccagactgcctttcaagggtatctttctttctatagctcaagttcttattactctctaatttaaattattcagttaattcccatcactctcaagtaaaatcaatacttcttaatctgaccttatcaattaggaccctgtgctacatgtaacagaaaccacaatccaaataataattaatgaaacctctatcttggcttatatctgtaaagctcagagtcttcaagggaggcctcatgccaggcttaaaccatatcaccagaatccatcactagtctgctttttctgattggctctctcatagtgtttataaaatatttgccacatttttcttggggtcagcttattcatgttcataccccaaagcaagaaaaatatatgtagaccctaacacatcccacccttacacaccaagcaagaaggctaaatgtcatgggtttcatgaggtaactttctccatatttgaactctaagtatgtggtggggtcagggaaggcatcttcttactcctgtttcctgaagagtgtgtagtagtcaatatttcctgaagcacatgggccgtaaggaagtaaaaattcagttcctgttatttaaagaaagggaaaatgggtccatcaggaccaaaaaaaaaatcctgcaaatgtaattacagtggtttacaagtactgccttcatctctacttgtttgctttgctactttccactcgtccagtgtatctttttgtgctcccaagaaaccattgagaagcactttcagatttttagatgtatcatctttttccaccttgaagactatggtcatgctactctctttgcttgaaacacccaactccattcttcttcagtactatggtttgaatttatccccaaaattcatgtgttggtaacttaatccttaatgcaatagtgttgaggtttttaaagagatgattaagtcatgagggctctgcccttacaaatagattaatgcagttatcaagggataggttagttctcacaggattgggatcctaataaaagggtaagctcagccccttcccttgttcctctttctcctgcatgtgctgtctcacccttcaaccttttgctgtgcaataatgtagcaagaagggcctcaccagatgcaggtcccttggccttggaatttccagcctgtagaactgtaagaaatatttgttctttataaatatttatttatatttataaacagaatacctagtctcaggtattctgttacctcagcaaaagacaaactaagaccaacaactgatactgagtagcgagactgttgttataacaaatacctgaaaatgtggacacagctttggagttgggtaatggctacgggctagaagaatttgaatgagcaagctagaaaaagtctagatcatcatgaatggagtgttaagggcaattctggtgagggcttagaaaaagacaagaactttcaacagcttaccaaccaaaaagagtccaggaccagatggattcacagctgaattctaccagaggtacaaggaggaactggtaccattccttctgaaactattccgatcaatagaaaaagagggaatcctccgtaactcattttgtgaggccagcatcatcctgataccaaagacgggcagagacaaaaccaaaaaagagaattttagaccaatatccttgatgaacattgatgcaaaaatcctcaatgaaatactggcaaaccaaatccagcagcacatcaaaaaacttacccaccatgatcaagtgggcttcatccctgggatgcaaggctggttcaatatacgcaaatcaataaatgtaatccagcatataaacagaaccaatgacaaaaaccacgactatctcaatagatacagaaaaggcctttgacaaaattcaacaacgcttcatgctaaaaactctcaataaattaggtgttgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaaatcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaaaaacaggcaaacagagagccaaatcatgagtgaactcccattcacaattgcttcaaagagaataaaatacctaggaatccaacttacaagggacgtgaaggacctcttcaaggagaactacaaaccactgctcaatgaagtaaaagaggatacaaacaaatggaagaacattccatgctcgtgggtaggaagaatcaatatcgtgaaaatggccatactgcccaaggtaatttatagcttcaatgccatccctatcaagctaccaatgactttcttcacagaattggaaaaaaccactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgctgcgtatctacaacgatctgatctttgacaaacctgagaaaaacaagcaatggggaaaggattccctatttaataaatggtgctgggaaaactggctagccatatgtagaaagctgaaactggatccctttcttacaccttatacaaaaatgaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaaaggctaatatccagaatctacaatgaactcaaatttacaagaaaaaaacaaacaaccccatcaaaaagtgggcaaaggatatgaacagacacttctcaaaagaagacatttatgcagccaaaagacatatgaaaaaatgctcatcatcactggccatcagagaaatgcaaatcaaaaccacaatgagataccatctcacaccagttagaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgttcatttcatcactattcacaatagcaaagacttggaaccaacccaaatgtccgacaatggtagactggattaagaaaatgtggcacatatacaccatggaatactatgcagccataaaaatgatgagttcatgtcctttgtagagacatggatgaaattggaaatcatcattctcggtaaactatcgcaaggacaaaaaaccaaacaccgcatgttctcactcatagatgggaattgaacaatgagagcacatggacacaggaaggggaacatcacactctgggggctgttgtggggtagggggaagggggagggatagcattaggagatatacctaatgctaaatgacgagttaatgggtgcagcacaccagcatggcacatgtatacatacgtaactaacctgcacattgtgcacgtgtaccctaaaacttaaagtataataataataaaaaaattaaattaaattaaattaaattaaaagaaaaaagaaaaagacaagaactgtagcgagagcctacattttcttaggagttacttaagtggttgagatcagagtattggtagaaatttaaacagtaaaggctactctgacaaggtcttagttgtaaattaggaatagggtattgaaaaatggagtaaataccattctttttataaagttgcaaagaatatggtggaattatgtctgtgtccttggactttgcggaaggcaacactttagagggatgaactaggacatctgtcagaagaaatctttaagcagcaaagtgtttacagagctacgtgacttcttttggttccttatagtaaaatgagagaagagagaaatgattaaagatggaatttgtaattaaaaaggaaacagaatgaaaagatttagaaaactctcagagcctagccaagtaaagcatgtttgagagagaatattaatagtgtgacaaaggtgtttgctaaagagatttatatggctagaaaaacaccaggttctgtttgtcaagacaatgggagaatgatcctaaggcatttcaggtgtgcagaatgcaacagctgtagggccatggcgatctactcctaaatttaaatggatgttgcgaagaacctgtgagccaagacagaggcttgtcacagggatggtgccaccccggagagcctccactgaggaaatgtccagcagagccataggagtgaggccactacataaactccttactctcataatgtttagtggagccatggaagtgaagtagaccctgtgaccccagaactacagagcaaccaatgtgcaactgcatcctgggagagctgcagccataagactctaacccattagtgctgctgggtggactgagccaaacaaaaccctagggacagggcttcatgaggatgtggggtcccactgccttcccattgtgcccagatgtgagacaagagctcaacacagattattgtctagttttaagacatgatatggtttttgttgttgggtttagtactgacttggggcctgtgatttctctttttgtgcctctctctctctcttttaaaatgggaatgtatatcctatgcctgcccccccattgtgttttggaagcatgtaacttttttgatttcataggctcacagatggaggggaatttgcctgaagataaatcacgccttgagtatgacccatatctgatttagatgaggctctggattttgaacttttgaggtgatgctggaaccagttaagactagggtgagataaaaagaatttattttgtgtgtgagaatgacatatgttttccaagccagggggcagcatgctattgtttgaatgtgtcactaaatgcaaaggtgttgagaaaggggacctttaaaaagtgattatgtcataagggctctgctttcacgagtaggttaatgccatcattgcaggagtgggttagttgtcatgggaatgggtttctgataaacagacaccctcctctgtctctcatgtttgtgctgtcttgcccttccaccttccactacggtatgatgcagcaagaaggctctcgctgtatgtgggccccttgaccttcgactttatagcctccagaactgtaataaataaatctctgttctttattacccagtctcaaattttctgttattatcagcacaaaacagactagacatgcagccattttccctctagacacatgcacacacacctatgacctatgtcttgtattgtttcttatgcttctgcattcatttcaatacttgctctgcaactctctcttacactcaaaactaggtgatgccctactgattttacagcctcctttacttctttcaccatcacacttattataccctactgcagtggcctggttttagctgtgtatcccactaacttacaagaaaagaattgtgtcttaatcacaacttgacccttattacctaacaaagagcctcttgagtgatccactttaaaaaactctaggcgatcatatcatgctataagtacatgaagaaaagaacaattataatgtttaggtaaacaaggaggagcctttgtagtaggtgaaccttgaaaaaggagtagaaattttccaggtcttagtttcaagaaggcatttcaggcagtagaaaggtatttcatggagacaggcaagtataagagatataccacctgttaaaatgaaactgaacagatccccgtccccatgggcgttatccatctgtgccttcaaatccatgctgaggctgcttctgcaagcttaagaaattggtattttgcagatccctggagtccacatgacattgtctggccttgtttgttactgctcttttttcagtgtgtaggaatgaagaatgagtgccaataaatctgaatgtcaaaagtcaaatacaaatgtcaaggccattccacatcactggttgttttgaattctgagcccaatttttgcaggctactatggtggggagaaccacttggctatgtctccatttacttatcaaaggctactccaggcataacagacctaggctgcaggcaaatggccttcttatgccatacaagcacagactaactcatcaaatgaaaaagaatagagtttgaaattcctttatgagttttaagaatatttcctgtgagagaaattttgaaagctgctcaattaaaagcaactgtacttcatatattttattttattgtgttgttggcttcatttaggttgaaattagggaatctagcattgttattggtgtttacttttttgagaagtagagcaactcaaattattcagcaggagcagaagggtttggttgatcctatgttgtatttatgccttatatggtattttaagatcttatacaggtaaatagaatcacataaaggtaagaaactaccggagctgtggctcatgcctgtaatcccagcattttgggaggccaaggtgggcagatcacctgaggtcaggagttcgagactagcctcaccaacatggtgaaacaccatctctactaaaaatacaaaaattacctgggcatggtggtgcatgtccgtagtcccagctactcgggaggctgaggcaggagaatcgcttgaacccaggaggaggaggttgcagtgagccaagactgcaccactgcatgccagcctgggtgacagagtgagactccgtctcaaaaaaattaaaaaatgaagaaaaaataatgaaaagagaataaactatctcctttgagaagacaaaggagaaaataagatatattaagctccgagtttgaatcaggaacttaaaaaatatacatatgttattttatttaaccctcactggaagcatgcatatttgcccaatgcctaactttatcaaatgttaatactctgtctcaaaaaaaaaattttttttttaaatcataccctatgtggtcttttgtgcctggcttatttcacttagggtaacgtattaaatattcacctatgtcatattacatattattctttgtattgcaaaataatatcctaatgtatgtatacgctacatatttatcagtttataaacatttgggtcattctcaaatttgtgctatgaacattcatgtacaagttttcatgtgtttatgtttttatttattttgaatatatatactcaaaaggaatagagtgctgggtcatctggcaactccatgtttatcattttgaagaactgtgaagattttacatttccaccagaaatatatgagaattcaattttcttcatattcttaccaacactttttgtcttcttgttattttagtcattataatattcaagaaatggtatctcactagggttttaatttgcattccaataatgtctaatgatgttgaccatcttttcatatgtttgatgaccattttaaaatcttctatggagcaatagctattcaaataatgtgtccatttttaaatgagttctttacatttttattattaaagttgtaagtgttctttatatactcagtggacaagtgtcatattagaaataaaatttgcaaatattttatctcactctatgtatcttctttttatattatttgaagtttattttgcctgatattagtagagctacttgagctctattttggttgatgtttgcatggcatatcatttttctatccttttaccttcaagatatttgatacatataatctgaatctgaagtatatctcttgtagatagcataaagttggatcatttttaagtccattctgctaatatctgccttttattggaatgtttgacacatttacatttaatgtaattgttgacaagtcaggatttacttctgcctctttgctctttgttttcaggcattatgggtctttctttactccctattcttctatcacagccttccttagtattaaatgaatatattaaaataccattttaattcccttttttttttaacgatgtaattttaaattttatttttgtagtggtttccctgtggattacaatgaacattttcacttaaaacaatgtaggaattcaataaacatttttacttaaaacaatctaggattgataacaacttagtttcagtggtagagacaatctttgctcatggatagttccattttctcctccttttgcactgttatcattagcatatgcatatgactttatgcatcataatataatcaatgaagtttttatgtattgcttaatgtagctgccctttaaatcaaatgggaaagaaaggggcttacaaactgtattgtctctaatatttatttatgtagttatctttatgggtaccctgtttcttcatgtgaacttagggtactgtccagtgctttttctatttcttcattttagcctgaaggacaccctttggtatttcttgtagggcaggtctgctattaattaatattctctttatttctctcatagacatacctttacttctccttcagttttgaaggacagtttcgctattggtttttttctttcaacagtttgaatatgtcatcccaccacatcgtggcttctatggtatctaataggaagcctgctactaatctcgttggaaatcatatgcgatgactccttttttcgatacctttacaattctctcattgtatgtgtgttttgacagtttaattatgatgggtctaagttattatgtcttttagtttatcttacttggaggtcattgagcctcttggatgtatgaattaatatttgttaacaaatttggggaattttcagccataatttcttcaagtattctttttgccttattttctttctcatccttctaggacttccattatgcatatgtcagtgtgattgatggtaccacatagtctttttgaggctttgttcccttttatttatctttttttatttctgtttctcaaaccataaaatctcaatttagctatcataaattcactgtttttttccttctgcctgcttaaatctgtttttgaacccctctagtgaacttatttcaattattgcccatttcaatgacacattttatttatttattttaaaaataatttctatataattattaatattctctgtttaaggtattattctcatattttatttaattatttagatatgaagtcctgtagtttgttcaacatattatgatacgttaaagtatgtttaactgacttaaagtttttttttattaacatcaatatatgtatgggcatccttggagagactttaacttactgctgtgctttccttttccccttcctgcccccacatgggtttacttttatgtttctttgtgtatcccataatttttattgaaagctgaacaatttaagtaacgtaatgtgacagctctgaaaatcagattcacctccacttgccaaagctcttatttgattactgatgtttattgctgttttttttttggtttttttttcatttttggtaactttcctggaataattctgtaaagtctgtattccttatcatgtgcagccactgacatctcttttccattaacttagtggtccactgatttctacagagattgccttaaatatcttcatcaagtagaactctcttcctttgccaaatattcacatttgtgctggggcaagccttcagtgctccagcagtttacaactctgtaattaccttcacttcttggtttttcaggattcaagatcagacagaggtgagagagtagggcctgctgggatctttcctacccttgtgcacaactctgttcatgcgtataacattgtgaatccctgggaatatgtagagattttcaaagcccagtaggaaatattattccccatattttcatcttaagctttttgacaagcttcttgtttgccccaacttgctttgctgcctcaggcatcagccacgttaaacaattgctgctgattgcttcaacaaactctcttatgatagggctttcctccctgaatgagctttaagtcaggtcagataaagtttaaaaaagtgacagttcttcagtttggaacttctgaagatctccaaactctacctcttccagtgtttagtggacttctagtttttactgcttttatggctgctagattgttaaattttaaagttcacacagagctggggaaagggggatggaaatagagcttaaaatgatacaaagcttgctggttttgttgttgtcatttttaccaaggttctgccttttttcttctataaacactccttagattgttacaagcctttggtttatttctagagttcttaaaaaaagttgattttttttacaaatgttacctatctttcattgattttatggagagacagatgtttggagggacttactttatcatctggaagtaattagatgtttggagggacttactttatcatctggaagtactcttcttcattgataggtcttaaaagttttggcatttcagtacaacatagatttatgtgaatttatctttcattattctgctgggtactcaaagggaattttaatttgtatctttaattctgaaaaattttcaccagttttatcttcaattattacgtctttgttattccttctgttcaagactttgagtcttattttgtttcctgttggagcttttaatctattcttcatctctattaggtgttatttcaatgttttttgtcttggtcttgctactgcattctgagttaaattttaaatattgtcttccagtttaacaaactcttctatattgtgactagtttttgaaatttttaggatgatttaattatttttttattttaattgagggtttttatttatttatttatttttttgacggagttttgctcttgtagcccaggctggagtgcaatggcatgccctcagctcaccgcaacctccacctcctgagttcaagccattctcctgcctcagcctcctgagtagctgggattttagacatgtgccacaacgcccagctaattttttgtatttttagtagagatggggtttctccatgttgtttaggctggtccgaactcccaacctcaggtgatccgcccacctcggcgtcccaaagtgctgggattacaggcataagccaccacagaggttttttgtttgtttgtttttttaatcctaccaataaactcagagttttcttctctctctttttttatttttaacaatctcttgggttttttattttggtttttgaaaatgaagatttaaaaaaaatttctctcctgaaacattcgtctgtaagttttaaaatgttgatcattccatctggagtaattcttctgtgtattgtttgtgatggttgtaattttaacattaaatttcacatgaattttggaatttggatttgctggctcatttttgagtgggagtttgttgtgtttcattttacttttcctctctgtttatgcttacttttttctccctaccatttcttggctcacattaaataatgaatcactataatgtaattggacgtatctgtgctgagacagtattagggagagggtagatatggtcacccagtcaggaagcatcttattgtctcattttaagtctctggctgtcatctccctaggcctgcagctaccaggaactagaaatctgaaaagtgttcagtgacatctctctacccccttatttattctggggagatttaaaacttaagccttctcagatccaggtgtcattcagaataaggttatgttgcaatagcttataaccctaacatctctgtggcattaaaaaacaacaacgaagtttcatttctcactaatctttaatgtctgttgtgggtcctgtggctatgtcttatcatcacttttattctgtgactgagatagatgagattgtctcttcctggatcaaaagcatatgggaaaactgatcagtggcttctaaagcttcttccacaaggcatcatatcatttttgctcacattccatagactcgaacaagtcatgaggccaagcctaacattaataccacaataaagtagattctgccccactagagggttaatattttatattaaagtataatatggtctaccaaattctctttcacttattttttttacctgtaatagtgtaacctttagctaccactgtctgctttgattccctcaaactgcctgaactattgcttcagctgtgaacaacactttctatttctattctattctgtgtacttgttttcttgattttagcccaattatctctctgattttctatttttctctttgtgtctcattgttctatgtttggagcataggaaggtgcctcagataataaattaaatatcctatctcattcataatggcatcaattttttttggtggaagaaaaacaaacttcacaaatccataattaaatctcctctctctcccacaaatcaccttttggaatcagttttagtatcagactagggaaccaacatcctctgtgtctggtatgagatgcaatctttatatttctttaaggttttggtgttaattgatccagtagaatttttatgtaaccaaaatttattccttggcctgaaatgttctctaattagttactataaactggtgcttattcagccgagctgtgcaattttgggacttttgggttaataaaagcctaatctgctcatttgtttacactgtttactccctaaaggcttatgctttgtgactgaaaacaatgcttaataagcagaagaaagcatgttaattgtaggcactgccatgctgctgtgtacctaagagctgggcttggctgcagctcaaacaggtcttgggtagaactaaccaagttgccctcaagcttaacttccaattgtcacaaaattcatcttgggcttagagatgaattttaaatacatcgaagagtaaaatgctctgttaccagagtgggtcagtggagctcagctaccatcgatctacactctaactctcttcctccatcaacctttacatcctctaatggaggaatgtctcccatatgaaatagtggccactcacccaaatgtaatattggtgacagacaaagggaaactaagctctaacctctctccccaccaaaagttcacatttcttcagtcaaatcatcatgtggacagaaatcaatttcttctctatgctgtcactgagaaagagggaatatataaaactcacgtataaaaatacagaagtaaaatgaagatctctatgttaagtgagtactatccagaataattgatttccattactggatatcttcaaataaatgattgatggtaatttgatatcacaaaagagaaagcagtattttttataaaaaagctttattggtataacagaggtataatgacattttttaaaaagttacacatgtaatgtatataaccttaatgagtctggacacttgtgatactgttaccacaaccaaggtgtgaaacatatcatcaagaccacagtttttgtgtatgtgtgcacattcatgacaggatatgtgttacagagctaatgtctttattttaaaaagctttattcatttggattttattccttactattatattctttattcaacagttgtctttccatctcatctctcctgattcttccccatgctttaaaaaatgttaatgtcttcttgagactgtcaaaaacaacattacaacaaatttctttatagatctaattggcttttataggtgatacatgaatcagggcagccttcattctacaaaactgaacaagtgttcttctgggcaggggcaaaacactgggttttgaaaggtgaaaagtaggaaatagaaaaatggaaatctagtaagcatcatattacctcaggttactttttttaaaggggtaaagcagaagagacttccttattaggattactgaggtaaactggaatctcttgttttcaggaaagattgttttgtttggggatctatctgctttcttaaattttcattttaattatgtggcatttagcatgagtgactccattttggtttggtctggtcgtttagggcctagtgcaggagttcagtctgaaacaatggcctcccataatcttgtttaacaattctaaaagaaggtcgttcctttaactctattcctctctgtggtttcatccctctcctttaccaatcgattcatatttacttttgtatgttctcaaaggcaagttaaataatactgcatactgaagtctgttcagtgtccccacaatcataataaaatgtctaagacagacttatgagcttctcaaactgtgttgtgggtgtacttttaggctcatgtgagatcatgaatatggtgcattctcctgaagtatcaattttactcagtactgaaaacattattctatcattaaaacaaacacaactagattagagagtatattgcaaaatctccatgaacttaatactaaaataagagtctgaaagccgactggtaccccagattgtcaatcagctcctattggaagcctgtcaagtccaccatagagcagcagccaaaccatttcatgggagagaacgaggactctgcagcgaagtctgaaagtgctgcagccctctggaccctgtggactctcaaaactaatcaaatggaatgtccatccaagacaaagccccgcaccaatgtgaaattgttgagagaaaaccaaaatttatcaaatagctacaatagaagcaaaggaaataaagtggtaaagagagagagagggggaggcaaagaaaaggaggaacaaaagcagcattaccacagtgaatgtgaattttaaaattattttctcatttattattttgcaaaaatgacaggagagggagccctagagccataatgctagaaaactatcctgacccttcctctttcctaaaagtacaaagaaactccaaagaagaaaagaggagaaagatgaggaggaggaggaagagaggagaggaataggggtaaaaataaatcttggtcaactcttatacaaacttattataaattcttacagggaaggagaatgaaaacagaatgatgcagacaaggaaattatgccataaagctagtcccaaaacaaatgaaaactacaacctaatattttttaaaaatagctaaaataagaagctatgaaaaaaagatgtataccagaattagaaaaactctgaaaagaggcaattagaaaaattaagatctaaaaagagaagtaacaggacaaatttagaaatgaaaatgaacctttttacaatcagtcttcatttttactccattgcgttcgacactgttgttctgaaagtctttcctgctctggactctggaagatgttagtccttctaattctcctgcagctactgcttcctgctctaattcatggctcttcatcactgccatagaaatgggacgtttcctatggctctctctgggccacatctttcagttaacttggcccagtggctgcaacaacttttaaagtttataaataactttaaatatggctgcatttcaaataaacccctcacttcttgacctgctccatacttgactatccaggtgcctttgggatgtctcactggcatttcaggtgggtcatgtccaaagtcacctactcagtgcttaaatctacctctcatatacaatttcataatttggaaaacaatgttttttttctgtcactcagattcaaaactccagaagcatccatcactgctttcttctttgtcatgttcattatatcaaatgtccttgtttgctcatgtctgcccccaaagtacctcgaatctgttctctcctttaactcttcactgccactccctcaacaccactctctacttgcaataaataactgttttttgccttctctgacttcattttgtctcatctgctagtgatgttgtcaaactgatctcaattggtagatcggagttgtcttctaggggagtttatgaatgtaaacaaaactgtgaatgtggcctcctgaagttgcatatttgacctggctctgtcttcttcagggcaacagattctcaacctggttttgttgttagtacagttgaaagaattaattttaagaaaaacaagtcagaagaaattacagtgcagtaactagtaaaataatcatgactacattaaaatatttttaaatacccttaaaatggttcaaggtattatcctctagaagtgtattgctatttattgccttttcaatactcttttgtatacctgaggcaatgtctttgagaacctacttgaaaaaaagtgtaacactgttttcctcttactcacagtaccttgtaccctgatatttgtaacatcacaaaacccacagagttaggggctgaccaaatatacacagtaagttatagtattgggtaaatgaaacaatcctgcaacaaaagattcttcagttccaatacagaagaataaaggaaacacaatttaattttgagaaagcattaccaggttgacatgtatataaggtggcacacaagaaactataaactctggacagaatcttacacaaatctatacagcagtcaaagaaagaacaatagaaacttctcttatctccttgagagataaatagatgagccctgtcatctgctctatagttgtgagatagcacagagctaatttgtaggtttacagttccaaggggaagaaggccagaaaactgaatcaaaaggactatcttgtttgggggtttattaagtttacaaggaaacaccccaaaggaaaaaagcgtgagtatgaagccacttctctcctcaaagaaaattttataatttatttttacagttgcaactacaatcacttgtaaagacaaatcccagattccttagaaactagaagcatagtaatgaagagttctcgaaacatctgcaagctactgtgtataaatggaaaatcactgggctatagagagacggtcagattttttgtgtgtggaatttttaatgcattttgtaatctcacatcaacttgatttttactcacatttcccactcctacatccttatctcggaccccttgggatatagagaaggactggctgggctggagtcagttggaatgcagacagtggtaggtcacacagaggctctgcaggtgactgggagatactcaaggttcataggataattggatgtcagtcattctgatagtggaattcaatgatatagaagaggattatttagacaatatgtagtcaagcagtctgccaataatttattgagtacctgctatatgccaggggctagataatttccaagaacagagtatatcagcatgatagagttctaacaaaagatgctgagacttattggtgcggctgtatatctggagaagagctccggtgtctagaaaatgagagaggtaaagagattttaccctaggctgggtgcggtggctcacacctgtaatcctagcactttgagaggccaaggcgggcggatcaccgaagtcaggagttcaaaccagcctggccaatgcggtgaaaccccatctctactaaaaatacaaaaactagctgggcatgttggcttgtaccagtaatcccagctactcaggaggctgaggcaggagagtcacttgaaccggggagtcagaggttgcagtgaggtgagattgcgccattgcactccagcctgggtgacaagagcgaaattccgtctcaaaaaaaaaaaaaaaagacatttcagtctaacgtaaaggaaatctctctagaaactggagtattatgtaagagatggtcttttgagaaatacaggcagaagccatgtagcatttgttgacaacactgatgggggattcgtgcaccaggcccaatggtgaactctagaatctctaggtctctagggttccttctaattcaagaagccaagtgagacactgtagcagacagtgtctccaggcagggtactgagcaaagaggatagtgaaaagggcagtgaaacatcggcctttttcactggcaacttcaagactcactgcctacaatgtaagtattcctcgtattccctaacaacagttcaactggaagagtggtttctgtgaatccctttgactttttatcttgccttggtcctggctccatggaggtccactgtccaagaatagaagagctggacccgccatgatacacccttcgtcatgttggccatgtctggataggtcccttgacttcagtgtctttcttaaggttcctgcctttggttctctttgcttcctctttggatttatagccggtttctgactctcttgtgcttgaatcttatttctcggttttctgtctctatcgccttctagactattacttgtgatttaaaaaactatatttgctagctatctgaaaatcaagttaacattagcaaaatgttttagcaatgctctgggtttctacatctttacttttctgcggaaggtgagagacatcttacatttggttaggatatttcttagtttcccttgtgatttttggttttaacaaatgagcaagccccagggtgattattataacaattatttttacctacgggcaagaaagggaaacatattcaaccactaacattgacttagctttatttttaagcatcccaatcattagcaccattcattcatttaacaaatattgaactctgttttacagtaatttactgtgctgaatgttatagggaatgagagtgtgcatattacatgttaatgatattgcctagcatttagtaggtgcttaattaatgttagtacatttggctgttgatgatgacaaaaatgatgaaagtggcatacatagtattaatgaagtctattttctgtattataatatttggaagttataggagattagcaaacaagctgcaaagtaccaaataagatatattaaagcaagagttcagtctcaaatgctagtgaaggaggcatttctaaatgtgactaggagtctcccaatttgaattttcacttcccttaaggtgacctgagcagaatccaaatcctttgacttgatgtgggtggacagctggtgcacagaggagctaggggcacaattgagctggaaaggctgttaactgaagtatcctaagactgcctaattaaggggaagagatctggggagctggaaggtgggaaagaattgaattcttctttatcaaagggcaaaggcaaggttatgaaagtaaatgagtattgtgttcagatagagaaatagtggtatagtgaatgcagcaaagatacttcaaatgactgagtcctgggaaaaggagcatgtgatggaacatgcctattaggcagactagtgtgttccgctagagaaaagttgcacttcgaagatgtggccactgtctggaggtacatattttaaaccactgtatccatatcagtccaaccaccatgtttaatctcaggaatctggagagatttatccatggtatcgggatcagtaagcactggaaattaagagcgtaagactgaagtaactatgaaaacttatagttgaagtggtcactccatcagcttccttatgtgttggcaagatagtgttagaaaaacatctttctttttctttctgtcttcaaaaaatgagctgacacattccatctggaatgtgtcattaaggccagtagcagattgccaagccctccaacaatgaattacagccatcaagctgtggcattggagaagtaagggttaatcattgtgtcattggtatccacagagttcataattttggactttgtgcaaatggaaaattgtaatcttcagctgccttttgccaggctacagaatggcagcagagtccaatgtgatagacatattagtggtaaaaagcctgtttacctggtgcaaacagggcttatctttcaagacactatttgaagagtacgcagaatttcttgggagaggaatattctggaggatggatatattcacttgcccctgtggcatttgttttctccttgtaatgtctgtgtgatgtgatggtaaattcagaatatctgttccaatagacacattcaatgtaacactcaacatgatccattgctatcccatgctttgctttcttcgggttcctttaaattaccaaagtctcttgtatgtgagctgctttgaccagttttcattttaggaatgagaggaaagcatctcttaccaaaaaagtaggaaaattccaccattagttacccatttaatttgtttcaaatagcatgtgaaaaacagcagtcatctaggtaaaagaatgggctgaatccactagaggtgcgtagtatgagttttttaaccaaattcctttactctaatacttttgtgagatcagatatagttaaagaatgtttgattgggtgctaggaaagtgagagaaaacagagctcattcacgacagagagaggaggccctggtgtgttgccacaaatgagtagcatcttggataaatgcaaatgtctggaagtcaggggagagtggatattagcagaaaatgaatgtgcaaaagggtttgaaatatttcaaactttataaatcagcttgaggctactctgcatgatctaacttttttgaaaacaaacatgctgatcaagggggtcaaattggtgagctcaggtttaatggactaaaactgagaaactaaaaattacagcaactgccaagaaccttgcatatccttatcagtttatgatatttactcagatatattgatttcaagacaaaaatatatctttcaaattgtgtctacataaaatatcagggttaatgtagaagaacaggacaacccatggagtagtactatttaccaggccctttatttttattttttttaaattttttgagacaagatctcgctctgtcacccaggctggagtgcagtggcctgatcacggctcactgaagctttgatctcctgggctccaaccatctgccccactcagcctcctaagtagctgggactacaggcacgcaccaccaagcccagctaattttcggtttttgattatttttgttttgtttttatggtagggacaaggctttgccattttgcccaggctggtctcaaaatcctgggctcaaatgattcacctgtcttggctcccagagtgttgggattacagatgtaaacatcgcacccagcctccctaggttccttattttgtgattgtgttgaatgtttactacaatcctctgaactaacacaaagattttatgatgtagaaaattctggtttaaagagtatcaaagaaaccgtctgaggctatgtgaatcttaagggaggaattttgcattcagaactctgtgaggactccagacccctatacttcctgtagatgatcctcccctccagtaaaggcacctgtgttgaatgagtgcagaccattcaagggattcggttgtagtatgacaggggcagtagaaaactttatctgtggatgtgagagtcggtttagaagtttattttggaaatgtgtggtcaatattcttttaaattgcctgtaaatgtttctgcgcttatttgtgtgggactctaaatgacagaatagatagggaaatctagttacccatctatctcctaataaatcattgaagacaattgcatcaacagaagtatgtgtatttcatctttgctgaagggcacatttaaaaaaatgttagttcaataatctcatttgtaaatctcagaaatcttgtgatgtataatttttcaccttaaagagtttctttttctttcattcattcatttttttgactttatgagagaatcagaatctctttgacatcatttgcagaacattgcagatgaataaaagggtggtgattgagttattccggtgttgaggaaagagtgtgggctttcaagtcagacatgcccatgatgaagcgtaaatatgtattttgagttataaaatgaagacaacaatacttctcacaggatcgtggggaaaattaaatgagataatggctacaaaaaatatttagctcaataatttgaacacacgaagtagtccctccttatccatggcttcactttacggttttagttccccaaggtcaaccatagtccaaaaatattaagtggacagttccaggcataaacaatttataagttttaaattgtgtactgttctgaatactgtgatgaaatttcacaccattatgctttgtccctttgtccagcacatccgcgccatccgtgctcccagcccaccagtcacttagtagctgtttcacttatcagatcaaccatcacagtggcactgtgctagtgtccaagtaacccttgttttacttaatggccccaaagtgcaagagtggtgatgctgtcaatttgcacccgccaaagagaaactgcaaagtgcttcctttaagtgaaaaggtgaaacttctggacttaataaggaaagaaaaaattatatgctgacattgctaagatctatggtaagaatgaatcttctaagtgaaattctgaagaaggcaaaagaaattcatgctaattttgctgtcacacatcaagctgcaaaggttttggctacaatgcatgataagggcttaattaagatggaaaaggcattgcatttgtgggtggaagacatgaacagaaatgtatttcgaacgacagcaatcaggttcagtactgttcgtggtttctggcatccacagggggtcgaggataaaagggggccactatagtaagtgctcaataaatgctagccacaaaatcattatcattcttattgctataatcacacatgagaaaatcaattatcttcttcaggccttggattccaatcttgtaaagtgaggtttaaatgagaatgcatatgtgaagcatttgccttacaacacaaagccttaataagtgccagtgactcttctccatccgttttcatccagacaccactttcttgccaactaactgccctttgctaggcttgagaatgcagacggtcaaaattgacgctattttcagagccacagaatttcaacatagcctatctgggaaggtacacattctcaaatttaccttccctgactacagaagttaccaaatgtggaaactttgatccatactttatctaattagataccaattagctttctgctataagaaatgtactactggggttagtactactgggggttagagcatcccaagtatattgaagccaatcatgtaattttcatcagcttttcttagaactcatttttagtcagtgctattcaaatgtattatgcacacaaatcccctgatgaacctgtgacaaatgaaggttttgtttcacaaggttggggaagaggctggaggttctgaatttctaaggtctcagttgatggcaatgctgcaagaccatccctttgagtggttagagtcttgggtccttgctaatattgtggtaggtaatgagccctcaccctagttagactgcagctttcaccagcagataccatcggacattcctttgatcgtatatcttccactatcagctttgtgtctcattttttcagcatactttcatttaaacgtgaatgcacttagagtaaaaccactcactgctcctcaaataattccctttaatcttgtctctgcgtcttttgtccctgtgtctttcttttatttatttatttatatttttctttttagtacccttcccctttgtcagctttgcaaaatccttccagaccctgtttaaatctttcctcctccgtttagaaactggcttgaaggggagaggtgtcattgccagatcttgaggccctgggaggaaatctgctggaaggtggggaggtgtatggaggatggaagcagacacatgagttaagaggctgatgtattagagcatgaaagaggtgacgtggtcttgaatctgggatgatctccaaggagatgttcctgatgagcttatgacttgggcaaattggctaagcaacctgagcctctgggcctttgtaaaattgcagagatggtcctatagtctctaaattatctttcagattaaatattctgaatttggtgggctgtaagcaaatgtgcacaggcctgttccaaagacttcttagtttggatcagtacattttagtatgtcacttctattgctaaaaatctttattttcaaatttttctgtcaaaggtttttctgaaacatcaactgagaatgaggggaaaatgttgctttaggagattttatctaatcttattaatagcaaattgtatagagatttcttatgaacatttaagaaatagaattcattcatcctaatctactgctagagaagcatttgtttatagagagactgggtcctttcatatcagaaagcaagtgacacctcagggaaacatcagctatggctttaagcagatgtgagtgtcaacaaggtttgagttcctcatgtgccttattgacacttcctgttataaatatgacttataggtcttttcaacaatgacaatgacaattgaggcctgaaattatgcccgattgtctgaatacttagataagacggcattattttctatatattttatttgtgatcaagttctgtgattgcctttctacttagtttttgctgtttttataaaaatatatactaaagacaaaaatcctgacctcattcacacatcacgtattagtagagcatgtatgaggtattgggtaatgagctaggcttctactcacggacctacaattaatgtgagaagtgaagctaaagacccaacctgatgattagttgagacttttcaagtatttctctctagaaaaggcattgatttgaggatgttgtttcacatttctgagatgcatctaggagttgtcatgtaccattagtatataaatccggagtggctaatcaggagggaaaaagagaataatttaggagtgacaaccagatacgtagagaagatgatgtagatgacagtctgatgggggtactggaattagtgcatagtacttaggtaagtctcatgtgttcctctgcagtttggatcataaggttgtctgatagagcctgttgtagacatcagataggcaccatctgcatgtaacccttcctatttctatttgtcctacctgcaaatcattttatttttgaagcacatctactcattgtctacatagactttaaagactcacactatattttatttcaactgtttcctgctttcatgtgatggaattacagctttccacacattgtttgctgccaagaccctaattggttattggacataaatgtcctgggagaaagtcaccatcccaacatgagttttagcctcttgcttttccaaatgtttgcaatatctttccaacaatttctttccctctaatcatgttctgcttctaaatgagacatctgtcaaagtacataaaaagacaaatgttataaaagtgaaatgatatctaatttttgacttatttagggggcatcttgacttacatgttttcattacacttgaaatataataattactgcatgttcaataacatcaatttgagcaagtaaacttgcaaggactcaataaggggaactgacagtcatgaatacctactttgtgtctggggatttgctaacattatttcattaccttgcaacggggtgtgtggagtgttgctactcatgtccacctatgtaaagttcagaggcctccatgagtccagaatacataattacatgaatcagagttaggatgtgaacacacatccataggactacaatgtaatttcctttcttgttggaatttaaagtgtgatccaaggccagcaacatcagcatcatctgggagcttgttagatacacagaatctcaagtgccaccccaaagcaaactgcttcagaatctttgttttattaataataagctcccttgatgaatcctatgcacattcaagagtgagaaatactgatttatacatcatgcctccaaagcaagcttctttttccctttttccctgtttcctgtcttctcttatatggctgcaaagacagtcatatggcatactttttaaataaatttatttcatttattttttcacaaaacacatctaattttctttgaaacagtccagggactcacagtactattccttgtttacaaatcctttttctttctttacctaaatagtctcctctcacagacaatttctttccttcttcatctttctcaataactgcaaaaattttctccaataaattgactcccattatcgtaagggggtagatgtatctggtgttaccctttctgtgttgtgaatgaggaacatttatggttaattcgtaggttcttcacttattttcatctcatttttcatgtatcttgaataattgctctcataaatgcccctcaaacataatttctacacacgtagtaaaaaaaaaaaagcacagtagtcaagtcgctattttgaataagcaccttagagtttctcctttcattttgtttatagcttataaatacagtttctacttacactgtgtatcacacagttaaatctgaatgatacattgagatcattttactaaatgttccagaaaataaatattcaaattcatttaaattcaataaaggagtcgactcatttcattttactattacaaattacttataatttttggtgatcagtgacattatgtaattaaacacacacatttttcttttaattttgagatatttttatgataatataaatgtgtgagatctttcatagatgattatatatgtgattaacttttttagatagccttagaatgaaaaaaatctctccaattaaactgttattttttagaaatacttcattagctttttctgcaatgacaaaacttttacctatttatgattaatagaattacccatgcttcatgttttaaatcaaacccggaatttagacaactaaagtaatctcaaaattatgaatttattccttatacagctacttatttattgttttttcacctgtcctgggataagatgataaaacaatatatggctcctgccataatattatgattaaacccacatataaacactaaaattacgtgaatttttactaaaattgcatgaattacatgtattggggtcagtgctacagtgttgtctgttcacagtagaggtgctatttggcttgagccttgaggaataatggcagatcaatgggtttagtactgaaggcaaagaaatgaggaatgctggcatatgctgtagcagtgactgagaggaggcgatggtgggatatgaagttggacaagagggtcaaggccagttcaagacaacacatgcaccatgcaaagaagggaacagccatgagaagccattaaagagccccatcccatattatccaatatatatttagtactcgccatttgccaatgattgtgctagtgactgtgtatgcaattcagttgtgtatgtaaaggagaaaaaaaatgatgagtctcagggcatattaaacaaagtagaagatatgggatttgaaccaaagatccactgttttcaacactcattcttcttctttataatcataaaatatatcatttatacaaaaaatatatattatatttataaaatgtgaaaaaaacaacattagtattcccatgtaccccatttaaaaaatgtgaacataataacaccattgagacaagtcctgtgctcctctgagatgtaaattatcttccttagcattcctaagtttgtaactatgtccccataatatattatatcttatcatacagaaacgtatttaaatagttttaacacataatgtatattttggtgatttttaagaaattcaaccttatgtttgtgagatttgtccctgttaacgtggctgtagagaatttactttcagggttcatttgtgtttcaacctcatttcttgtttctagatttttgctttactatcaatgacactagagaatttttatgtaagaaatattcatctttaattctgcaagagataatcctaagtagttttccaggtttttttcagtgatttacacccccattctcacaatctgctttccatgaccttgtcaataaaacttcattattttttttaaatttaagataatctactgggttgtaaaggcatttcaataatccaatttctacacaggtttttttttttcttataacttgttgatttttatatttctgctcttgtgaaagccaactcctgatttgaaagttgctttttcttattgatatatataggataggtattttttacatattctggatactaattcctttggcaattatgtgtcttgtaaattacctcccagtttatggcttgccctatgattttgacaggcagaggttcttaattgtagtacagttaaagatatcagcccatcctaattctttgtgtgcttcatgtcttgtttaaaagtagccctaccctaaggttatggatatgtattggtctatttcctttgaaaagttttaaagatctggtttttatacttaagtataaaatccatttgggattgacagttgtgaatgatttagcagtggatctccaatgctgtttttttctatgtgaatgtttttgaagagttttaggctgagatgttgcactaggttcatttttgcttaaaatggactggattagtatgtgactaaagacaaacagatcagtaaagaagtgactgaaggccaggcactgtggctcacgcctgtaatcccagcactttgggaggccgaggcaggtggatcacctgatgtcaggagtttgagaccagcctggccaacgtggtgaaaccccgtctctactaaaaatacaaaaattagccaggcgtgctggtgggtgcctgtaatcccagcaactcgggaggcggaggcaggagaatcacttgaacccgggagacggaagttgtggtgagccaagatcgcaccactgcactccagcctaaaaaaaaaaaaaaaaaaaagaagaagcgactgcaatagtccaagccagtgatgctgagggtgtgaactaggtcgctggtaataggaagaatagggagacatacaagatattaatacttaaaagccactaaaaacaggatttgttatctaattttaatgggtatgtcatacatttttctctttaaattcttatgaattttcagaataaaatatactactgccctactatggagaggtgtccttgtgtgtcctttacttgcagtgttcttcctttagtcatttgcagggccccttccttcacttccttcaaatctccactgaaattcactttttcactgggggctcctttgagcctcctttgcaaaatagccatatctgtctcccaagcatatatacatacaaacgcctggcaatgaatgcctgcctagctctttaccatgatatgtattgcttcatatgacttataaccatcttcacatgatttgttttgtaatgtttatattttcactagataacaaactctatgaaggaagaagcttcacctgtttgttcactgccatatcaccagagcctacttctgtatccattaaatattcgttgaataaacaaaagggcagaaagaacttgtatgtcaatgatgtgcgttccctttttagaaagggaggcttgtggcgaccttctaaagtttttggaattttaaccagcttttgtttctcctgcaatggtgaaattctggggagatatcagtgacccatttggcttagagctaccttcctattagattctattgtaacacttgtggaacaggtgaaaagtaaaggtgacaggcagtaggaaccattgggaatacaccaatttgggctgcacatgccgaggttagtccattcatcatctttattccacattgacagtaaaagcaatgatctctaaattaattagatccttagagataaagcaaaataaaactgtgaacattaataggcccgtatttcaacacctgcctggactgaggcaagctcttcctgttcaattgctttccttccctgccatggagctgcattcaccagcagtcctccagggggcaggctttgaaattttcagagttggattgcccagtctgtcttaatccatacttcagggaagaaaccatgatagttgactgaataaacatgtaaaacaccttgtagactggatcctacaatctttggtcacaccagagcttggcaagcatgttgtcttcaagccacactttagagacagaaacttaaagagatgtcagctggcttcagtgttggtatgaagcctgatagctcagctgagttaaatgactcccaacaaccaaatacatggctcttctagaccagggtttctcaaatgttaatatgtatataattatgtggagatcttgttgaaatgtaggttccagttcgctatgtctgtgtgggaatctaagatcctctatttctcccagtctcctctcagttgatgctgatattcctagtccctgaatcatcctttgagaagcaaggcacctagatttctggtcaaaatgctgaaaattaacaacccaaatttaaagatatgtggtttgttttgcttttttgttttgtttttctttgaggcaaattactagaaccaaccaaccaatgaaggttcttcggctcaagaacaaaaagtctactttgaaatttacattttgacatgaagcaaaataaaatgttaagcctagttatttttcatttaatcctaggtgagataaaaaataatactgcttctattaaactgacataattatagtaaaatgtgggtgaaataaaaataagatctttattgtatatggaaaatgtagaatcaacactgctaaaaaccacatcaataaaacaaaaaatgaatttaaaaagcacactcaggatgcaaaagcaacctctcaggagataaaaattagcataagagttatgaatgaaacaaaactcaggaccatagaaatattgagaaacctggcttatcacactcaaataaaattactcagtagaaactaacatgtagacattttctgataagttttgaaactgcaaagcaaaagttagatgttttattctacatagtacaaaaaatatgtttatttcaaagaagataaccagacaaaatttgaatttctcctctgcaatagtcaaaaccagaaagcaaaaagaaacatctataaaagtgttagaaaaatcaaatgtgaaccaagattttacatcttgacatgttgtccttaaatgtaatagcaacagaaagacattttcagtcatgcaataactcaagaaatttatcagcaggtatcaatctttgaaacctgtgctcatatcactcatggcagaccacagcatgtcctagatctgaaatgtatgagtgttttgatgagttaatcaagttaaagtaaaaaaaacacaaagtacattattcatcattattcataccctctgtttctcttttttttttttttttttttgagacagggtcttgctctgttgcccaggctggagtatagtggcaaaatcttagctcactgcaacctcttcctcccaggctcaagtgattctcctgcctcagcctcctgagtagctgggattacaggcatccaccaccacacctggctaatttttgtatttttaatagaaatgaggtttcaccatgttggccaagctggtctcaaactcctgacctcaagtgatccacccgcctcagcctcccaaagtggtgggattacagatgtgagccaccgtgcccagcctgtacctttttaaataagtcttagtatattgcattataacattgtagttgcttccatatgagacttcctcgagagcatggtaatcttgagaacaaagatctttatttacacttttacacctttatttgtattatcaacaatatgctcagaaaatgcttattaattaaacgggctgtcttttgtaacacagtctcatttatattcattctcttaactcctagatctgatcacgtttcagaattttgtggtggagaccataaaaatcattgacaaatcaaatttagagattgtatattgaagcgatctttccaaacccaattttaatttttaaagtaactgagggcccaaagctgtgtctgaagcatgacttggaacgtgtgtacacacaggtcttgagaggactatgggaaacagcagctggcctggcgcgtgactcctcagtcccagattcatagagcatcagggctgctacttagaagttactcgtactctgtgcaggtggcacggttcactcccaggaatgctcttcttttcattgctaatcattgttcaccattatctttgcaggctttatcaggatctcctttgatgtaatttgtagtataattgaattgcagcagatgaaagcatttcctcccaagctctatgactcataaccaagtggttttcaattatgtcagcatgtagctttccaaacaggtcttttcattgaccactatttgtatacactattgagttaactttggcaaacataccaattcatagactactgtggattctaattaaactgagatggagaaagataaaatgatcattaatttacattaaagagtagaacagggtgtttagagatttgcctaggattaattttataaataatattaatcactatcattactagtaaatgctaatgcacattctaaaacccagaggccgcatggggcttctccccgaagactaccactgatgaggaagcctgtggagccaggtttatgatatgggaaatttcttgatcctagtgttaaataatttagtattctctcatcctcccatgatgcctctatagtagaaaggccgacagctacttctgacccatgagaaaacatttcatcctgtaaagcctaagagagaattattttttgagttttaggaccaagaagtcagaattttactcttttattttcattttataataaccaacaatttcacatgtattttctgtataatttaaaaagcacttttataaatatcatcttacttcattctcagcactaagcctgtatgagtcatagtgaacacttgcacactatcatgtttggtagtctgctaagcactttatgtgagaggcctcctttaatcctcacaactctgtgttgtgccacctgagactgtatccattttacagagaaggaaagtgcagtacagaaagtttgcatagacttctagagatcacagagctactcagtactggagcaaaagtccaaacccaccatgctgatctgcttctagaaaaatgttctcatgattgttgctctgagagtgtgcattgcggtcatcgccgtcctcctggtttaaagaagtatcttccaaaacccatgttagtaagaggttggctttggtcataccatcctaggaaataattttttaaaatttgctatggcatcctgatgaaagtttgttgtgccttctccagagtttccataaaatgtccaggtactttttgctttcattttctgttccagttaaactcaggacctcccttgcatctcacctggaacaactgctctttactctttggcccaaatgtgagacctggccccatttcattgatttccccaccatttgtcaaagaaatagcaaagctttggggaaatgtatgaggtgttcacttaaaagcttacaacaaacatcatgagaggtttgacacttttgtttctttaaattttttgtgtctactacctaaatttcctcaaaaattttctcttcctgatctttctcttgagctctctgctttcccccatgtggctagaacccttctttttcctctcctgatgtcatgaacttataaattccctttggtctggaaatctcaatattctcattgtaacatgtgtatatgtcatgggatcctccaggtgtcacttcacctggaggttcacagaggtttcagctggaaacctctgtgtccggttgtgccttctgcctaagtattgctcacacctgctgggcttattccgcccacttcacctggcaggctgcactcggctcatgctactggcctggatcccacacctgctaagggtgagccaggggtgcagcagtgaggggtgtgtgggcaagcaagcacggagaccagccactgtgcactggctaggcatgctggctgctatggcagggcaggcagctccaggcgctagcacacgttttggctctgtgtgaagctgtggctggaccacatgtggtacatgtggcatggctgaatggtataattgggcatctgcatctggacgagaggaacatggtgttgcccagaagcttggagacaccaggaaccacagagccccaaaaagggtgtcacagccctggcttagggatcccctatgtctgggctccctgaacggccacagctcttctctccttcttgtcacccacaatgtggcaagtgggaggtgaggtgtttcagccatgttttttgttacagctcttctagtcctgccatttggcgtatcccgagttcttgtcccacatccaggacgaatgaggtatgcagacaactggagggtgatcaaggcaaagaggagcttcattgagcaacagaacagctctcaggagacccgaagtgggtagctcctttccgcaggcaggtcatcccgatgagtgtccagctctcagcagagaggagacccaaagtgggtagctacttttcacagacaggttgtcctgatgtctttctgtgagtccagctgagtccagggttttcctgggcttcagaagggaggaaatgcatgctgattggtccatgggcagccatgggtgggcccagaaaaagcaccataagttctcactcctggccgtggactccacctggaattccacctgaaggtgggtctttaccccttcccacagaggagcctgtctgcctcctacttccttaatcatgttgtccatagtgcccagtctgttcaagtggagggggcctgcaggcccacactgagccaccctcagcagccccaactcagaaggaggtggggctcccagctgttccaggctcccacaggctcagcagagcacgcagccccagccatgcttctcctgctgcaactggcatccccgcacccagctctggacattagatacacgtaatatctttgttgcagtcctcattttcccagaccatgcctgagagtgttccactttgtatggaggaatatgtgggtattttcataaatgaggacccctctactagaaagtaacaaagtattttcctgaacaaaattgtacttatctatgaagtagaagaaattgtatcagttttggttttaaattctaaatgatcttgccttttccacgctgctgaaaagatttccccagtttccagtcttgcattgtgcatttgtctcttcccctttaattcagcaattctactgatggctttccaagtaacagccccttctgtatcattgtggcctttggaacattttggttcctggactgcctttcttccaggacctcaatgaatctctcaagctacagatttcaatagcaaaattaccatttaatagctgagaaaactgaagcccaccaatattaaataagttaccgaaagccaaatggtgcctgagctaggactacaaacctgatatggtagattttttctatattttaagcctgaacaatgcaaattgcgatttcatataaatctcacagttctcagagttctgtggcctgtttccaggcacttgtgcttgttggttctttttctttttttgcataaacttgctttgtttgcttctcttacctctactcctggttattttgtccaaattggtccaagtttgattcaggtaagcctggactcttatctccatgaagaatgaaggtgtatgccccaaaacaccgaataaagatggactaaatggatgaaaagagctactcttggtaaggaagtttgccaggatattacactagaagttcaattcagcagccattaaaaggtctgtttccctggggagttctctactgaaaagacattagagcctttctcccttgcttctttttgtatagcagcttttacatggtagctgctgaatgcacagaataatgtggctgatccattgaagacccagcttgctcaggttagaaagacagagctgtgttactaggcaaagtgtaagaacaatttatgataaataagtgtgatgaagggaaggttcttggcttcactcaagcctgcggtggaagaaagcagctttacttaagcagcagtgtttatgcttggtgattgccccttgcagagcagggctagcccataggcagtgcgtggagagtagccacgcatgggctgttggctagctgcatttatacccactattaattgtatgcagattaggtggtgggttatttagaaatcaatagaaaatggggtggtaacttctgggtgttgccatgtgaaggggtggtaacgcagcgttgccatggcatttgtaaccgtcatggcactggtgggagtgtcttatgctgatgggcagtgaggacaactagaggttgttttctgtgccacttgctggttctggccagtgtcctctttggtttgggaaacaagccctgcaagtctcctacttcaggaggctgtggaagagggcaactaacttctcaggagggatcagaccattgcaggacaggaggcctgtggaaggaaaagaagacaggaggagatggttttcttattttagaaaaaagaaaggttttcttcttttagacacctgggccatgactcttcacttgttctttctcaagaacagtctggacactgagaccagaacctgggacttttaaattttaagcatatttttatgtatatgttgtcctgtctagcggagggtgggggagtctttcttttttttctttgcataaatctctaaattaaaattctccagctattgttacacataaattccagggctgcacagatcgatctgagtgttcccattaagtttctgattctaatgaagggaggactttacagcatcttccactgtctcccaacgcatcacacctcttcctgcttttccctgacccacctgccatttagaaaaacatattctctcagccctgctttgtgctctaaatgttaaatacatttgattgtccatacaattttatttgaaattcaatatctgctttggacagaaagtgttattgacctgctgtatccatacactatttactttgaaaataaaaaagtggatttactttgaaaagaaaaaaattttaatgatttttttaaaatcctaagtaatcatgatgatgcccttaagaaagtttttaaaaacataattagacgtattttgtaattgggatcattcagactgccaagtgttcaagcttttccttatttgaaggcacattaattttttaaaataatcattaacgaagaatttacttctcttaaaactaggttagctattgttctctctctgtctcaactaatgagtttgatattcacaagaactaattgtgagattttgtaaagccaatgctatgtcaactatgctggaataagactttatgagaaaaacataaacatacataagctgtcaaataaatcattctgaatgatgtggtagaaagcttggtgctaggagacctgataggaattttaatttacccatttacttattcatcaaaagtatataaagcactgatcctaagagaagcagcaaagccagctgcaatttcccagcagtgtaaccttgcgccaatgactatatcctctctgatcctttgtcaccctaaatgtaacatgaaggaaaaaatatccattacagcataatataataattactataaaatataatatttacccaagattcttatgagtatctgatgaggtgacatactaaaatagatgagacaacagagttggaagcattttagaagacctaaagtcattagtggtgtttgtgctaataatgaaacatctattactctgggtcctttgctgagttccataagaaggagaaggttatgtaagaccttattgtgggctttacatgctttggcatccagtacaatggaaagagttagaaaatagaggagcattgaaagagaatccccaaggctgggtttagtactgcaatttgcaaatgagggcattagtgaaaagcatcctccatggatgtgaagcagaacttgcagtaggcagcagtgctctgggagggcattttagagggggatacacagcactgaaccttgaaagatggagaaactcagtgaacacagatgggtccggaaatgcacacaggacatcagtctacttacaggatggtttccgagagcaacaaagtgagtgaaaagactaacaactaaaaatgaggagaggtttggatagcagagaagagtggagtgattcttccttaaaggggaattgacacttaacatcagatgaatgacttagaacctagatctatcagttatactttgcactgaaaagctacaaacttttaacacttagctgtcccatctgtgaatctctgtggctcattattgctgtgaggattaggtgaaataaatacatcacagtgtctggcatatattaaattcctaataaactttcagttttatttttctactttccttttccttctctttatattggcagtggggtttctggcccttaatttagagtggaaacaccttatggttttctcttatcacattttatgacttagatatctcttatgtttatatcatctgctccctacatagtctgggcccggaaatgattatactcagagcatctctagcaagacagctagataagcagataaatgcagccctcaactttttattaatcaattgaaactacttttccatttaaatcaaagccctttaaaacttccgaattatattattaatgtccaggagaagatatgccatcagttaagtatcctctgctgcctattggctgctgtctacttattgtaaaaaaactagctatttctaagtgttgatgatttcagatttgagttcatcttgttaagtggttcagaacatcaactcttagcatacattccctactgctaaataaaaggtgacccttcttttaatcgtttttgtggtttctcattagagaataggtaaataatgaaataactagagtcttcccttgctttcattcagttttgtgttgttctttccttccagttctttgcaactacacgatcaaaaacattttttttggtgcacattaaaaagactagagaaatgctttaatactttcgaagactgaatatcttaaaaatggctccaattctactgtcttattcaagcaaggtatttacttcttatttcttttctatccatttcatgaccttgttttatttcaagcactatcacagagtcagatggaccttaactcacctgagcaaaggcaacctagagccacacagctgagctgccctctttgtggcatcacgttgtccctctgccccacagagtcacctccccacttcccttttccagccctactgcccttttgtaagtgtaagacatcatttcctctcaactgcataacagaaatagcctctgaaagggcctttttacagctgatttcttctgtctccaattcatcgtccatactgcatccaaagtcttcttgccactgccttcaaaatttaaagctgattcctaaattatgaatctttgtcactgggaaggcaaaggacagttgcatagtctggttgagtgaagttttgcccacacttaactgaaaaaaaaaaaaaaaagattcctgtgccccttctgagacttgctgaatcagatttgaggaaaaatcctggaaatctataaacttagtaagcataataagtgacatttataagtggcctctttagaaagccagccctgcagagtacacagaatgaaaatctaaaagtctgagaatcccaggttagaattgcaatactgcatttaacatctgcagagagcttccaggtaagtcacttaacttccctgactacattttcccattgaaaaacagaggtattaccaacttacactcatcactactctgaggctcaaatatgacaaaatacataaaaaggctgacactcaatgtataattgaaccttccacttccctttttgatctaaacaattactcttctgaatatggtggaaaggttgaatggtacatttctccctccttccctgctaccctgccccccacatgccagctgggcttgcaaaaggcagaactggattccaaaattatagcagcagccagtatggtcttcggtttccctgcagacacatgagtcaatggagacccacaggactgaaacatagagggtttatgtttccctgaaaagcaacagaactggcgaaaacagctctgtttctcagagatgagtgcaaactggacttataatgaaaagtcaccaggatgtgcccagagaagtttccagcaggaacacctgcccaaagaataatgtgggaccgtgcttcagcaccacattccagaactctgagtccaaacagacccagactaccgggaagctcctgcaagcagagcaggacaggtgttgatgcacatctgagacggggagttcctgggctcaggagaagggaaagcctcctgagcagcagcccagcagggagagaggcactagccagtgggtctacgtccaagaactgccacaaaggtcttaatgcatggtgccaacactatactctggctattgccaagcttgactcctcagaggatctctggggtcataacttgctctacacaattgttctgaaggtgattgcaggtgtgatttctagaggtggcctgaggcaggctcaagtggaccccagattattgagacctagaaatgggaggcacacactctggttaggtgggcagatgtttaatgtggaatccagtatggggcatggtttgtaggcagcattttgcagaaaatatgtccaatatgccctgcctggttttgtgaggccagttccagtcccctcactaacctgtcctggagtctggatggcttgattaagattctggaccacagagaacccagacaactgaagctatctttccctgcaagtggccactaaggggtctttcctttcttctaaagctcaaagcttcaaaatagtggtgtgaggttgaataagccatttaatctcctcagtactctcaagtatatagcggggctaacaggctgactgcggctaactaggataacaattcgaatgcctagtatacctgttgtagagtgctagcctcattgttattccccttttacttttccttcttctgccagagagatcatctgggtattcatttgtgtgcttaccgtctgacacttgcatttacatcattatctgccactccaggttatttttctcctctgagagccaaggatgacaaaatcttccttagggtaatcctacctgtggagagagggcaagtacgaatggtgtttctctagtacctgcaggactagtaggtgtggggatgtaagagcactgaaatgaaaaagtgaacatccttagagactggctgctttgggagtaaggcagatgttctaacgatttagagaaactctcagaacaaagcagggataggctttgggaaccaggatatgggattctgaagtgggaacaaatccaaagaagcatcattcactcatttcacacatttatcaagacactagaatgtgacagtgaacctatcagacttgcttctaggcttatagagctgagagagtggtgagggagactgttatgtggtcagaatggtgcaccatcaacgttcccccactcccagttaggactaaggcactgattctcccagctactgggaggcttggctgctgacaggtgagagctcacagctgtatatctcttccagaattgcctttgcggaggagagctgacacaggtgtcagctagcatcttgcagctggtagacacagggacccagccctcttccctcatctcagacaaattttatcttcagagtaaccccagggcttgactgaggtctccgttgcagctgcattacagttcacttgttccctagacccagttcttttttttaattgacgtataattcacgcattataaaatacatccatttaaagtataaaatttggtagttttttagcatatacataaaaagttcttcaaacatcacccctatctaattccagagttctcatcacctgcctgccaataaaaccaaaaacaacaacaaaacaacagcaacaaaaatccatactcattagtagttgcccctcattcatacctacccccattccctggaaaccactaatctactttctgtctctatggctttgcctgtttcagacattttattttacatcttattatacttacgtagccttttgtatctggcttctttcattcagcataaacttttcaaggttcttttacattgtagcttgcaacaccatttcattatttttattgtcaaataatactgaattgcatggatataccacagtttatctttttatcaactgatgggcatctttcctctttttgattattataaacaatgcttctttgaatattcatgtgcaagtttttgagtagacatgtgtttttaattctcttctctatatacccagaggtgaaattgctgagttatatggtagctttatgttaaacatattgaagaacagtcaaattgttttctgaaggggttaccccatttttcattctcaccagcaatgtatgcggggcttcgacttttctgtgtccttcccattacttgctattacctgtctttttgattctagttatagtagtgtgtgtgccgtggtattccattgtgatttttattttcctctacctaacagctagtaatattgagcatcttcttatgtgcttacaggctgtttgtatattttttttgagaactgtatatacaaatattttgcccattttttaattatagacactttttttttttttttgaggcagggtctcactctgtcacccaggctttagtgtagtggcatgataatggttcacttcagccttgacctcctgggctcaagtcatccccccatttcagcctcccaagtagttgggaatacaggtgtgcacgaccatgcccagctaacttatttgcttagagacagggtctcactgtgttgcccaggctggccttgagctcctggactcaagacatcctccttcctcagcctcccaaagtgttgagattacagaggtgagccaccacacccagtcagttggtcattttttattattgagttgtcagagttctttatgtattatgcatccaagtcctttatcagttacatgatttacaaatattttctcccattctctatgctgtcttcactttcttcatggtgttctttaaagtacaaacatttgtcattttgatgaagtcaggtctatcttttttattgttttgttgcttgtgcttttggtgttatatctaaaaaatcattgcctaacccaaggtcatgaagatttgcacctatggatttatttctaagagttttataatttcagctcttatatttatatctttgatacatcttgagttaattttttcctttgtgcagttctgatcatcccaatactttacaggtattgctcccaagtacactacccaataaatctcttacactaaaatatttatctaaagtttatttttctagaatcagacagattattcatagaagtacaggtacaatatggtaattgaggaagtggtggaaactctaagcacagctgtccaggcagggttctgacggctggcatccttccaaagggcaggcagtcctgtagaacatccttactggtttggacttcttttttcccagctttgctctaaaatctatactattttatgacagtgtttcagtcgtagagttcaaagcacaggcaaattgacattcaaaacttattatcggatgaagttacatatctgtttatatatttcaacaagggaaagctaatcaatattctgtagcaattgttaccatgtaacatacgattaaatattataaaagtgagcctattacatgagaaataaatataattatgtttggtccaggctgttaaaaatgcatactttctatatattatatgttaatgtgcaagatggagtggatttctgcttatttatttaaaaagaaattaaagtagtacatttagcgtacattgtgtgtctagatgtttacagattgattgtctttttggagatattttagcttattgtattgtaccatggagtaaactttatgctcagaagttctaaaggaaaaagtgtaagagattactggaattgaagatttttgcatttatatgtttaaattaaattttgattagctgttttaagctttgtcaagcattaggagctcataatcatagagagtttgatatgaaggataccataatcagctactctgtgctttcattttacataaaaagaatcttcaactcaaagaagaagactggggtaattggccccaggttgtggatgaatcagctatgactccatttggtatccatatctgaccattcctagccccagggctcagttcttgcaacaagctgcctggatgttttccaatgtggctcaatgctgttaatttaaaagatgcgtaagtttctgttaagacatttgtgagttggggcagaggaataaaaggcatgtagcttttttcatcaagtgtgacaacacctgggtgttaggaaacacacataatcaacttagatgctcatcagtggtgggctggatgaagaaaatgtggtacatatataccagggaatactacacagccattagaaagtgaaatcatatccttttcagcaacatggatgcagctggtggcccttatcttaagcaaaataatgcaggaagagaaagacaaatactgcatgttctcacttacaagtgggagctaagtactgagtgcacatggacgcaaagatgggaacaacagacactgggcctacttgaggtgggagggtaggaggagggtgaaaatcaaaaactacctatcgggtattatgcttaccacctgggagaggacataccttgtacaccaaatcccagagacatgcaatttacccatgttacaaacctgcacatgtaccccctgcacctaaaataaatgttgaaaaaaaaagccactaaaatagtatttcacatcacttttcattgctaacagtttgttccgtcaaaatactttctaaatggatccattattgtttgtcagtatataataacgtgtgtaaattcccatagatatgcctgagttttacacttttcatttcatatcagagaaaaaagcttgaaaaataactcttgatattgagaattttaacagtgagattttattatactcaaatgaacaagttctcatcttcatagcccatatgtgagactttttgttaccaaattgtaaaaaaaaaaaaaaaaaaaaaaaaaaaatcatgtaacgtagattaaaaatctaatttcaaagactggaacaacaacaaaaagaaaacaaaggcaacagcacacagatgactgtgacttgcctttggcccatctgcagatattaaagccctggggccagaagcaagtctttctcttgctgagagaggacctgcctgcagcaactcctaggaaggctgatgagcaggtagtacttcctggagcagaatgggccacccttctcctttggctccattcagaggaatagccccagggagaggtcctggaaagtattataataattgcagaaatgaaagaaaaaacccttgttctgaagcaaagggtggacttttaattttaatagtagctaattatccgtgtctgtaataattctgctgtttttgatgtttttaaagattaaaaacaaaatctcagaatagctttcataaatcaatttgaccttgccgtgaaaccaaaacaacggttaattcactcgaagcagagatataataggttcaaatagcaacatatctcccagagtcaatttcaacaagacaaaaacagaataaagtggttcatatttttatgttaaaagtaattttataggattccttttgttgcgctgaatttaaataaatcattataaacctaatatatgcctaatactgtcaccatgctgtggcaaccactgttaatatttccatgtgttttctttgaactttttttaattctttgcatgggtttttaaaagagtgttttagattctgtcataccagatggagaaacctctgcccctactctgaagggatatccccaaatgacattccttggaattctgcatcccttgaaaaaggacgactggctgtcttctgcatgagctgttccgagacccactaaaattggccagggtgactggtacagtcataggagggttcagccaagccatagcattgtccagagcaaggatggcgtaaagaaggctttaacaaaatatatttgattataaaaaaaacttctgctaggaatgtacaaagttcattgtccatccggacacccaggaataagtgagaggtacatactaattagtattttctaacattgcttacttctgccccctgcctagtcacaggctgagagaagaatgcagcaagaagcatcttaactggaggcccattctaagtccattttgaggatgaggaaacaggccagggaggttaaacgacttgtcccaggtactgtggctggaagagaggctataccttacctactctcctgggtgcccttttacctctgtctttagaggaagtgcatagatttttctcatttggctcttgagacctgggataaacatagtgctaccctaagtcttgcagttacaagaatggaaatattctgatttaagttatagacatttgtttgaattttaccattacacattttttaaatcacagataagatttttcacttgaatgaaaagtgaatattataaaccatgaaagcttatatgaggctacaaaataagttgggagtggctatctgagaagaaaagaaagatgcaaaatctaactggcaaaggaataaaatcaaatcagacaccaacataaccagcttcttccgccttcccttagatgatagtcctgaagctgctatgctgaacatctgatgggaagtaaaaggcattaacactctgtaaaacatggcaaggaatatattctataacagttcccctgcagatgaaaatttgccctgaggtatagttcctcagagaaaatgagtttttttctctttagtaaattttttaaagcctttttgtttgtttgtttgacagcctgtgctgcagttctaggttctaagcatatacaccttatattcctgttaatggaatttcagactcaatgtttgcctcaccttttgtgtatagttcctcaatggcctatattggatacaaagtcttacacagttttcacccaactctagtgattaaaaaaaagaaagatctgattggagcacagtgcagaaggagagagtggcatcattttggagctctgcatttctggatacctaccttgcctttgtcacttgtcaggtctatgattttaaagaataattgaactcctttgaatcaccactttatctgcagatgaggtctggaatagtcagagatggttttctgtaacaagtgagtttcatttgggatttgtataatcagaaagatgataaggggcaaaccataatcaaagccccagagatgcttagcaatgagagcaaccatgctgaggcatagtaaactatgacactgatcagataatcaaggtgaggtgcaaagtcaggtagaagtgctcagtgctgaggtagtaagaactagggaaccaatagaggcttttgactcatggtctgagaagatgagaaacagccactggaagacagatccagtagatggacaagagggattgatttgaatattttggagcctggggagtaacctagagatgaatatcgccaggtcattcaggtttttgtttggttgtgtgattacaactaacagagactataatttaaaagcttggtggaacagattactaacaaactaataaattatcccaatctcaaggctaatcaaacctatattttggttgatttttctacaaggttgtgtcaaggttataggtaaggggtgatcactgagtccccgtcaatgagatacttgcccctgggtggacaagtgagtactagttgccataaataaaatcaagcacctctgctaccaacatttttgcatttcacatcagagagctgagttccgtatcttctcatggtgatctttgatccaagttaaaggccgacattaatgttaacagtattttctctactgtatattgtgactcatttttgagttgcagatgagactgaaactagaacttctcttctttgcagagtcataagtcatgttaaaatattaaaagctcagaatagtcctaatcggtttaactttgtataaacactcagatatcttgcatttctttgtttacaagtccatttctcttgtaatttccctgaatatccaatggacctagaactgtccaaaacaatgtagacaatcgctaggtctaagatatttgactttaaccaaaattgttaacaaaatatcttttccttctaggacagtggctcaatatttaatttcattggaaaccacaggctaagtctgagtatatttatgagttatattttcagctacctagatgatttacaacatgataatttagaaggagtagaaaacttggagttaaaaattctgagttaaaacctatcttgatcacaacctaagactatacatgttcaatggatagtctttttatttattcagtgtagtttcctcatttataaatataataaaacccacctgtaggtaatcatgaggctcaaaaacgactgcacatgagaatcttttgtaatagctaagcctcattagaagctgtattctggtttgaatgtgcttgtagcctatatgtttgtgttgctgcaactcctaccttgctaaaaagagataaaggaacccatctagggaaactgttatgctaaggttgagttcctaaagccatggtgtacttcaaattagggaacaggaggagttgaacaagaccatcaaggaaaaaatttattatatacagatttctggcacgatttacaaataggcaggtccctgggctgatacagaacatgcaatgctgatatgttctggatatctgggacagtgtttgcaaaacaaatagaaattgaatgcctttatgttagtcataggactcactgctaatttattaatttacgtcttgctcaagacctatttatgtccctcctttgttcccaggaacattagaggttgctaacgttgctctaagacttgagcttaattaaggtgacctttgagatgaactggtccttatcagggccagtgaggccatgaagagactagatccaagcagtatgttttaactggcctacacaggtctccctcagcagccctgagccagggaactcaacaatattttagggaaacaagaagtctacttaactgataggagtcagatttgtacctgggactgctgatccaaagcctataaggaaaaacatagccaaaaagaatctgccttaaactgatgtgaactgactatccagatccatataattagaaataatattagaagacatcttaatgtatatagtatcttatggaacacagttttttttgtgtgtgtttttaagcagactttatgtaccaaattaagaaattattattttaatgatgaagtcttggctgggcgcagtggctcacgcctgtaatcccaacagtttgggaggccgaggtaggtggatccctgaggtcaggagttcaaaaccagcctgaccaacagggtgaaacctgtctctactaaaaatacaaaaattagcttggtgtggtggcaggcacctgtaatcccagttactcgggaggctgaggcaggaggattgcttgaatctgagagacggaggttgcagtgagctgagatcgtgccattgcactccagcctgggtgacaaaaaaataaaaaataaaaaagttatttgctctagggcatgcagatggaaaggggttgcaacaggtactggagtcagcattgctgtccaaagccttatatgcacccacccccccaactacctacctccctgggataagattactaatgacattattttccttaggagcagacctctttcacacagcagtatacaagctgttttgctttctacctgatgttgagaaaggcctgactcttagatgttgcctgatagctactattttctcactttgcatcacattagtgggagccgttgctggagagtttcataaggaacattctgttaagaatgtgtaaatttagattactaccactgggaatttaaaacaatgaagagaacaaattctgctaaaatatggctctgaccatctttaagacagatgctgtgaccgtcctttagctcatggctaatctgaaggagctagtctgtggagacaggggcttccttagcaatgcctcagataaaaacttgggcccagttctcaaactcataactgaaatatttcagattaaatccctcctccttgttgctgatcagtccacgtactcttttccttaaaccccattgaaaattcactgtcctctaggtgccatcattctgtagtggtgggagtacagattggcataacctttcagaaagcagacaggcaatacaaagcaataataatatatggcaatattaagggagtctatattcatgattgagtaaccaccatgctgtgaaatgaaatgtggtcaaagatttatatgcaagagtttaataacattgcattgttatttattatagcaactctttcaaaagtgtgcgatgagagggtattatttatataaataactttgcaatcatatgatggaatattattctgccaagataaaattatgtatttgagaaatatacttactgatgtgaaaaagtgcttaagacataataggttaagaaaagacagacagaagaggtatgcatgtaattgtgtgtgtgtgtgtgtgtgtgtgtgtgtgtttctgaacatcacaggcttcattagccgatggatacaaagagatcacatcaaagtccacagtacaatggtcttacaactttacaatcttctcacaaagcgagtacaaacctgtgctcagtaccaaacccaggtagactgttttctccctttcctggccttcttatcaaagctgtttccatggaccttgctgtggacatctttcattagaacgctctggtagctgtatcacttagaactcagggatgccattctattagaaaggaggtgctcttaactctcaaatttttcttggtcttaaatattgcattgagataagggaataaggaagaaaataaaaatgcatctaatgcctaaaaatatatggactgttgctaggcatttcaccccattcatgtcatctgttaattgtcagatgttgtcactctctctgtttttaatacagaacttcaacagatcttaagagcattctactcagtcattttagatttgaggtgctattctgctctctaggaagatagggagtctcaatcctgacccagactcagttcccgagtgcggtactgtttcccactgacagatgccactgactttgcctgcctgagtctctaaatattgcagctatctagctgtattccatctgcccacctgtttggactttcatgagtccaactgctttcctggcctcccaccagttgcctaatagcattctacttgatggaatccatgttccctgcccttctgcataccagcatctgcagccgaccttccaataccgatcccagcatagtaggccaatctaggtccaagaccaaggtctcctagcctaaggatttaccactgtggttaaccctgccctgcctgggcacaacaccttcacaattcttgaagcactacgtgccatgacacacacatttgaagtttttttcagaatcttccatgtttaaacttttggctgttccagtttccccaaattaaattatctggaaagagtgagcagctgaaatttgagtgcatttttgaagtttaagaactgaaaaaagaaaggaatatggccaatttaatattcctgtctcttaatccacttcacatgggagaatggaggtgaagtgaggttgtggaaaataataaagccaattactttgcctgttcctttgtttgatatactgcactcttttttattttttcttttccaaaaagcagagatcagccagtacaaaatggtggttttcccatcctgggtatatcaggcccagatcatcaattattattgcagcattctatatttgctctcatagatagtgaaagctttgctatattaatgaggaatttttgatttcaggctgtgccttctttgctcgtctcagctcttggctcttcctaaaaactgtattagccaggaaactgagcccactgattttttaatctatccttaaccctgccctggaacacttagcaatttaggcatgtggcaggaagaactgaaatttctaagccgttcactcctgagactaataccgagtcctcttcatttatccttgacctttttagttttcagccttgctccctaggggtacttccatgaagacagttgcttcctgccccatattaacaaccctcagtgaatgtcacagtagagtaacagcgaattgcaaataaagacggccaacaatcatttggcatttgaggaaagccatagcataaaacagggtcactgaacttaataaaaaggaaaagttatgagagtaaaggaaatatcatgaatggcctaatctttctgtcctggatggtctttattccttaataccatcaaccactcaaggtgctgctgtgtccctctcagaggtccactctcactcctcctacctgaaaagaaactcactagttgctaattaccaatatccacttagggtgagttggttgggacatgctaattcctccttgctgaccctactgtgatattcctgtgattggcctggtcatttttccctgggcctcacttgcagcaagctgcttaggtaggaaacacttagagccactcctcacattatgaggtaagattctcctctggttgtctgaagctgtaatctccattttcaatctggtcctccttcatttccagatgtgttaaggaattttttaaaaaatttctatctgttatgtcattaagaaggatttgtagcaggaaaacgaggctggcaccttttctcaagaagctatcttgacctgaaacttacattctttcatcatcatgccattttcatctggtttcctgagagctgcctttggcagtcacagttggaaatgacattttatacaggctcttatatcagagcaaagtatggtcctgataaaaggttgtgtgaaaatgttcagcaaacacctctcaatcccctgtgctttgatgtcctgcatgcttttataatggccacactccagggcagctggagacaggaaatttcatataactgggttgtgtctgaacagaatcagcacactccacgatgagattcaccatattcacatttggtatattccctttccatttctttcaaacttccgtattaaaaatgcaagatttacattagtatagaatactaaccatcaactattatcaaaggaaacagaatggggagatgaacaaagagaaagagatgacccagaatcagaaaccctgggttagtcttggctctcagtgattaagcaatttgtccagcatcacagatctacaatgatcttacagtctcaatccctcattttcttcttttacaaagccaatggttggcagaggctgactagatttcatgaccctccatcttgttcctgttctgagcttttatgaagttgatcttattgtcatcagcctatcatcagctttgcaggacagccagatgaaaggagtgcaggacagacactccttagaatccctttgtaagtttttcaaagatttgctttgttcagatctctgaaccattattggggactgtagaataggtactgaagaagaaagaatgcctcgcttaagttcaattcagtcctgtacactcagagtgatctctctgatatgagaaagggagttgttgacctttggattaagtgattccaagagaaaggactgtttagagcgagggttagcaaactaccaccttcaggccaaatctggtccaccaactctgttgtatggctgacaagctaagaatggtcttcacatttttaaaaaatcagaataataatattttgtgacatgtgaaaatcatgtgaaattcaaatgtcagtgtctgtaaataaaaagttgtattagaatatggccatactcagttatttacctattgtctatggtggctttagagctacaacagagttgaacagttgcaatagcaaccttctggcccccatagcctaaaatatttactatctggccttttataaaaaaaaattgatgatcattggtttacagagatgtattgagagttaacaatctgcaggacataaggaaagaatagcaactgatagtttacagatgtcttcatgggaaaggtattctagaagttcaaggacaagatattattgagtataaacatacacagagcaagaagcagcagtggatgtatacgcttacaaatgcacaggcagatgccccccatgtataaattttcaactcggctgtcctttgtgataacacttggcagaaaaaacttcaataactgaacacaatacctttagcgttgaccattgttattttcttttttttaattatttctatagcattgacattttattaggtattgtaagtgatctagaaatgatttttaaatatatgagaggatatgtgtaggttatatgcaaatactgtgccattttctttttttattttattttatttttttatttttattttttctaattttttttattatactttaagttttagggtacatgtacacaacgtgcaggttagttacatatgtatacatgtgccacatgtgccatgttggtgtgcagcacccattaactcatcatttaacattaggtatatctcctaatgttatccctccccactccccgcaccctacaacaggtcccagtgtatgatgttccccttcctgtgtccatgtgttctcattgttcaattcccacctatgagtgagaacatgtggtgtttggttttttgtccttgcgatagtttgctgagaatgatggtttccagcttcatccatggccctatgaaggacatgaactcatcattttttatggctgcatagtattccatggtgtacatgtgccacattttcttaatccagtctatcgttgttggacatttggcttggttccaagtctttgctattgtgaatagtgcctcaataaacatacgtgtgcatgtgtctttatagcagcatgatttataatcctttgggtttatacccagtaatggtactgctgagtcaaatggtatttctagttctagatccctgaggaatcaccacactgaattccacaatggttgaactagtttacagtcccattgttattttcttagcctcttacccattggcttatttgtgctaagttttgaggattcctttttaaactgatgtttaactgtattatattcagtgagtacaaaagaagtgagagtttcaaaactactgataagaaatggcatataattattaaagaaggaaaaataaagaagacgaaaaaataaagggaagttaacgatcactacctgataaatatttggacgcgaatcatgattttgaaggacaaagaatgaaatgtgtgcaaaagcagtgtggatacaacccagactaaccagctggtgcagagggacactggtaaactagacaatctttgcagtgtgtcttgtgtttacaacaatgcaaatgcccgttagattaatgctgttgagaaaaagaacaggagttttggaatgaaaggctcatcatggttaaaatgctgctgaaaaaatgcttgtcatgaggtgcaggagctttcaaaggaaaagggtcactattgtgtcaaagaaaacacagctcctagggagtcataggataaggcacttataggatcatcaacaaacagtagtacctgcatgtacgcattctcagagtatgtggaaattggcttatttcaaaaaacaaaaccactgataggctcaatagaatgttatcatccaggaggagcaggagtgatgcttaatttgaaagagttggagtgtctgcacacaccatcatttgctgccaatttatttagcactaagcttaaaatcctctttggaggagtaactttggtcttttaaagaaaagaaattaaagcaagtttttagaaacagacattagtaaatgcacgtgttcttgctgatacatacagagggaagcagtcagagagaaggatgaacagattataagtcaactctgaagggtgtcagtagaggttcagtaatgggcagagtctagaaaatattatcaatatatacagaaatgtctgtgtatgttaaattaagggaacctctgcagagacgaaaagaagagattttgtaccattcatgatgacatttgaaaataacatttttaaacctctcattttatggtgacaatagatgcccatctctttcacatagagaagtttaatttgaaataaaagtaaggaatattctttttattttatgatgacagtctcatgctcaacaaagatttagagaagttagtgcaacatggaaaattgagttgtggtgtaaaatgtataacttcttgctacatagctgattgtgaatttgttctttatatgaatttttttaaagaaataattgaagtttataaataaaatatttatgaatatgacttcattaagaccaggtgtcaggtgtatcttagttctgttttaattatatacatatacacacacacatatatatttcttttatgttctacatactctgctttatagctgaactcatctgtatttgtccattttcatgctgctgataaagacatacccgagactgggtaatttattaagaagaaggtttaatggactcacagttccacatggctggggaggcctcacaatcatggcggaaggcttgtcttacatggtggcagatgagaggatgaaaaccaagcgaaaagggtttcctcttataaaaccatcagatcagatcttgtgagacttattcactaccacgagaacagtatggggaaaaccgctcccattatatcccactggatctctcccacaacacgtgagatttatgcgagctacaattcaagatgagatttgggtggggacacagccaaactatataatcatcatccaaactgaaagttgtagtaggatttgtattaacaaatatttgaaatctgagttataatttgtcaaatctatgatatgcatctaaaaaattaccattttcttaaaatggttataggatactctaatattcagctagtaacaagtgctttttgggtcaggaaaacattttttaacaaactgatacttatcaaatcttagaagtttgatgtcattatgttgaacttctactacaattaagtgagaagataaatgcagagtaaaggtttctaatagcattttttatttataatctcaatatatgttcatttcataaaattttaaaaattaagagaagtgtgaaaagactctacaataccatcaccaagggataagtaataagtatttattttcttttatattttttaatctactatgtatatgtataaaaatatagatattattgagtaatattattgctttcattttccaaaactctcttctaaatagtatttctatttttagttataattttaaaatttaagtggcttcattgtttttataaaatatgtgattattttaaaatgtaacgatgtatgtacacaaaataaaaatacatgaatatatatttatatggaaacgtatacttataaatgataaaagaccaaaataaatgttactccaaagtctacaactcagtactaattatattaaaaattaagtgaatatctttctaaacaatcactctgctgatttatatctatctataggtattaaatatcccaagaatgtacagatatctccaattccaattcagtgttacagtattcattctagccttccctctttccttatgctaccttccttcttcaacagttaaaagtatggctttcattatctataacatatatacttatttgttcagtcctaatatgcacataaagaatcccacaattttcaacctatatctgtataaaaaacaagtttacttacttaagtgtagcatttgtgcacaaaaagtgtttgataaatttttctgggccaaaaatagcaactgtaggaaactgacaaaggtaggacaaagacatggttttccctcagatatccgcgtagttaactccttcactcccatcaggtagtgctcatgttcctgtcttctccgcagcctacgttggtggactattaatagcataatctcaccctccaccccacctagaccatcttgatcctttttctcctactttgtttcccatagcacttatcacattatagcgtgcatgttcaacatacacatttttttttaaagtgtacttttacatctctgaaaggtggattctgataatcaatgacatcataattcaattggaggcttgcaatgtactgtattttagatttaataagtcatggcacataatttgcttatttatcttacattctattttgcccaattaggatggataagttgacaaagtcaaagttattaaagagaatatcgtaactgctataagaaagcaaacctcaaatctcagtgcattaaaagaacaagggtttatttttctcttgtgtcatcgcaggcactctgttccacatagggaacagagcaccctctgttggattctctacctccagtcagcttaaaatggagagggttgaaaattacttaaaagtactgtattcaagagaaagcctggaattagagtttatcacttctgcctcgtgtctttttttttctgtattaatcagagtattctaattgctgtgatgttgtgggttgaatcctgtatcccctaaaaagacatactaaagtcttaagccctagtacctgtatcgtaatgtaatattacttgaaaatagtctgcagatgtaaccaagttaaggtgggatcatacaggattaattgggccctgaatccaatgcctgatatcttcataaagagagagaaacttgaagatggaggacacacagagaagaagttcatgggatgactgaggcatggactggagttatgctgccaaaagcccaggaacacaaaggattgctgccaatagccagaaactggaagaggcaaggaaggattctttcctacagccattggaaggagtatggccctgctaaccccttgatttaggacttctagcctctagaattgtcaaagaatgaaattctgttgttttaagccatttggtttatagtaattcattacacctgccctgggaaattaataccccactccttgtaccaaaatgcgtatcagcgttctctagagaaacagaagaaatatgaatagtgatgattaattagtatactgatctacattatactataatcacattatataatcatatcctatatgaagagatttattttagggagttggcttacatgattatggggtctatttagtctgagatctgtagggcaggccagctgactggaaattcaggcaggagttggtactgtatccttgaggcagaatttctttttccagaaaaacttcagttttgctcttcaggcctttagctaattgtaggatgaggccctcacaaactattgagggtgaacttctcttacttaaagtcaaccaattgtagatgttaaccatatctccaaaattctgtcacagcaacatctgaattagtgtttggttaaataactgggtactatagcctagtgaagttgacatataaaggtaagcatcacatatgaaaaagtaaatcaacatttttgctacttgacccaacaaaagtttatttctttctctcatcatggccaaatattgtgtctattggtgtggatggagaggaattctggcctccatatagccacagaaaaaattgggaatgaatttagaaatacagaacccatctcgcagctcatccctctagggctgcaggataattttaaaaatcacttgaggtcaggagtttgagaccagcctggtcaacatggcgaaaccccatttctactaaaaatacaaaaattttccaggcgtggtggtgtgcgcctgtaatcccagctacttgggaggttgaggcaggaggaacacttgaacctgggacacagatgttgcagtgggctgagatcacaccactgcactccagcctgggcaacaaagcgagactgagtctaacaattaaaaaataaagggcttcaagtgttatatgcttgttttgacttgtatacatgccagtagtgatgcctcatacagaacttggcttaccgaatgatcaatacacattaactctcttttttcctttcatatctgggaataaagttgatgaagctgcatcatctagcccaggaactagaatatatcttttttcttacattggtcagaactcagaaacttggctctgcttacctgcaagggcatctggtaaatatagtcttcctgtgtgcctgagagggaaatgaaatgttttgatagatacatcataaccctgtctttgctgtgtagggcttttctgctttgttcaatgttataatccaagcatctagaatagctcatacagtagttcctgctaattcatgagggacatgttccaaggccacagagaacgcctgaaaccatggatattactgaatcccatgtttttattttttaattattttcttagatacagcatctcaatctgtcacccataccagagttgtagtggtggtattatatgtcgctgctgcctcaaacttctggcctcaagtgatcctcctgcctcagcctgtggcgtagctgggactacaggcgcaagccaccacacctggctaaaactatattttcttttatacatgcacacctatgataaagttaatttataaattaggcacagtaagagattaacaacaataacttatgataagatagaataattataacaatatactgtactagacactatgtgaagatgatctatctctctcaaaatactataatatttttggaccataattgactatagataactgaagtcacagaaggtatatttgtggagaagatgggggactactgtattagactctgaaacatgcttattgcattagtaattgctatgatttgaatgtttgtcccctccacaactcatgtggaaatttgtcattataacagtattacgaagtgggacatttaagaggaattatgtcatgagggttacacccaccttatgggtgggacgggtgtcattctcaaaggacaatttagctccctttgctctctctgatcctctctgcccttccttccatcatggactgatgagcaggaaggcccttatcagatattggccagcccccaatcctagactttccagtctccagaaatgagagccaatatatttctattcatcgtaaattacacagtctgcggtatgctgttttagcagtacaaaacagactaatacagtaatgaaaaaggaaaatgccaacataaaatcaataataaatacaaggaattctgaaggaataagcttaagcatattagttattaaaataaatacaaacaactgaattctctcatctaaagacagatgttaggtgagcacagcaaagcacagctatctactgtttaaaagaaacacccttcaatgataagatggaaaatgaagggaagggagaagggatactaatcaaatgcatttaaaaaaattggaaaacataaagttaaaaagtagcaatattaatgagcagcgagatgcaagggaaggttaatgggatgaatcaggataaaatgagacattaagtaatgataaaagcacaatttatcaagatgatatccagccgttaaccaatataaacctatctacatagcaactaagtatatatggcaaaacatattagatttataagagtttgttgcaaacataattataattgaaacctccaacatatcatttgtcatagttaaatagatctatatataaatatatataagaacacaaataaattaactaagactatgaatgccataaatagctgggaatttaaatgaaattcctgcatattagcaaagaaaaataaatcacagacaatggcagaaattataaaagaaagctagctagctaatatgttctggtgagtgactccttttatgggcctcgtttatttgtttcaaaaacatttccttaagtgtctctttctaattaaatcccattatgcacaatgatggactctgtatttagtccttattgatacaatactgctgcactctctattaatccaaatatacagaagatgttgggagtcagagtgcagtgctggggaaagggctaaccccggatgccaaaactggttttgagtcctgcccttgttatcactgatgcaatttaaaatctctgatagttgcagtatgtatcttgaatcccaaactggagttcaagtttgagatattacttactagttatatgatcttggacaatttacttacccttattgagattcaacattcttatataaaaatggagaaacaatctctcgggatgcaagtctgtctacaacttaacaacattttacaggatagtacaaaatagttaatctcctaggatccaaaacgcctctacaatcttttttttttttttttccaaataagaagctgtatttgtgttagaataactaaaagactgatgaagacagtgtttgcaaaataaaataatgctttcctcaaaggaacaacaaaggattaattaaatgagtattaaaaaaaaagtctttgcttctatttctcaaatttcaaaaaaataggttggaaatttaaagggcttcacaggccaggagtggttgctcacgcctgtaatcccaacactttgggaggctgaggccggcggatcacttgaggtcaggagcttgagaccagcctggtcaacatggtgaaaccccgtttctactaaaaatacaaaagttttccaggcatggtgttgtgcacctgtaatcccagctacctgggaggctgaggcaggaggaactcttgaacccgggacgcagaggttgcagtgagctgagatcacaccactgcactccagcctgggcgataaagcgagactgcatctcaaaaacaaatagaaaataaaaaataaagggcttcaagtattacatgcttgttttgacttctatacatgccagtagtggtgcctcatacaggacttggcttactgaatgatcaatacacattaactatcttttttcctttcatacctgggaataaagttgacgaagctgcatcattgctcttactgtcataaccactgatgttatccctactcaataagcccttcctgaagaggccagatgatttccttttttacacttatgtcattattgaaaatgaggaattggtgatctacaaaataagttgtgatactggaaggaaaacgccaatgtgtgcttatacgtgtaaggcacaaggggattaaaaacatgcctgggcaggcaaaaaaaaaagggtgtagatgttaaaaatctttataggagaaagacagaagttgtgggaaatggataaactggaaatagaaaataaaaaggaaaaaaaacaaacagaaaataagtcaatgcaacatttgtctcaaacctttgcaatatatgagggagaaaagtagatatggaagagtataaatattttaacaaaaggaaaaaatgaataaaatgaaaagatacaacacagtggatattttatctaccttgaatatttctgtgaaatcgaatcacaaaaagtactaagaaggaatattaatgcaacctaaacttaaagctaccataaatacatacacacatatagcacactgagaagtgagtagacctcaaacttaaagtgcataagattaaccctgggaatttattaaacatacagctcatagaatttgcatttttatcatgcactgtagctgattctgatacagattgtcaacagtctatagttgagaaacactgtctggttgaactatacttcaacattacccccggagagatgaatgtcctcctagtattttcatcctgtttcatgggtgggattatagactcaggacaacttagagaactgaaaatcatgtttttagctatgcagcagataccactatactctgaatgaatactctgtatcaagcagaacactcacgaggcttttttctaaccagtggattttggctacgagagaaaaagagatagcaaacaagcttggcacaagattcagaagaaaagagacttgaagcctccctggaagagaagataagacaacctgcaatgcttagaggatatttaatttcagcattctgaaatttggggaattataatagcagatgatgattatgctctccacagatttattaaaatacattttaaaaaaatgcatttttatgaaacaaatagagcttactttaagggatccctgaatgattattatttttcagtatcaaatagaattcaaagaagaaagctgtttaatgttcatttatgaaggactgccaaaaattcaaaggtagaagattctctgcttgaaaaagcagaacaatcagcacaaatggaagattttgagagtaatgtcaagacggtgtgtgtgtacaatatgaagataataaaacaaatacataattgtaagcattgcatataatggggtataataacttctaaatacttcatttctaagaaaaggatatccacttataaacgatataaatctgaagttctcattacataaattctgcagtagtttggttttggagttgtggtgcaaacagaaccacatagaatatacaaaatacgcacctactatgagcgagattgtgcttgtgcttttatcaattaagataatgttcagctgcaagagccagaaaactcaattaaaccatggtttgagtaaattgtgggttttgtttttctgaagttgtgggaagtacagaggtgtaggagtctggggctgttacagcactgcagactcatcagagatccagttccttaagttcttctcatctaccatcgtagcatgtggttttccaaactcatgcagctgccttcgaattgcaggaaggctgctctgtccagcctccaggctgaagaaagagggcacccagcaaatggcatgtggcaattaaatctgtctttagaaagagcttttctgaaagccccatttggaaattatctgctccagtcttataaaacagcactgtgtcacatgaccaccctacatggtacaaagaaggctgcaaaattcaggattttagttggctacgttgacactttgaatagatgtggtacagtggcgagtagatatcaagtaggcaaatagcaatgtctaccaaattagatatattatctaatttaattgttttacaaattacatgcatttcatttcttcaatagatgaggaactgaaacatagaaatgttaagtaacttatctaaggtcaaacatggttactgaaaggtacagtctggtatgaaagcccatataattaaatgcgaatatcttttcccactatatcacattcctttaggtaccaccaagccaaatattttcagatggtaattttcagaaaaatgtgtatatcatgaatacttcagtcagatgtattttgatggtggagactacatttcctcacctgagactgaaaatttatttagggcaccgaccatgtcttcaacacttttgcattcccagtgcgtagtccagggttgtatcagtagaaaccttgagatgctggctaaatgtggattaagaaattgtattttaagctcacagaattcgacaagattttaaaattttatttattctaatatcctcacaaggttcacagagcatgttatagagtaggcattgagtaaatatttgctaactttaaataagtaattaaaatttgattttattgcgagatatcagagaaacatatatgcagagaaaaaagcatgacagtaaaaggagtagtttgtattagagtcatgagtttgacacaaagctcacagggagctggaaatgcatgaatggataaattggcctttgctgcacttcaatatgatgaatttcattgagtcactaaaaaatatttgttgagcacctactttatatctgacattgtgttggatgtcatagatacaatgaataaaacaacacaaacacgtccttgtggcttaaattttgtcttctaaagatgtatatgttatgtcctgcccaagactataggaatccaactcttgcatcaaggtaacccagatgtgaggacatggattcaaatgagatcattttggagctttatgatttgactgccctgctggatttcagacttgcatggggcctgtagtcccttcattttggtcaatttctccaatttggaatgggtgtatttacccaatgcctttacccacattgtatctaggaagtaactaacttgctttgattttacaggctcataggtggaaggtacttgccttgtctcacatcggactttggactgtggacttttgagttaaggctgaaatgagtaaagactttgggagactgtcagaagggcatgattgtgttatgaattatgaggacatgagatttgggaagggtggtaggcagaatgatatgatttggctgtctccccacccaaatttcatcttgaaccgtagttcccataatccccacatatcatggtgggagggacccagtgggagacaattgaatcacgggggtgggttttcccatgctgttctcatgatagtgaataagtctcacgagatctgagggttttataaagggtggttcccctgcacatgttctcttgcctgccgccatgtaagatgtgcctttgttccttctttgccttctgccatgattgtgaggccttcccagccatgtggaactgtgagtccattaaacctctttttctttataaattacccagtctcagttatatctttattagcagtatgagaatgggctaatacaagtcctaataccagtaactccaattaccttatttggagatggaggtctttaaacaggtaatcaagttacaatggggtctttagcatgggcgctaatcgaatataactgatatccttatcaaaaggggaaatttggacacagacatgcacatagggagaacaccatgtaaagatgaagggagagattggggcaatgcttctacaagccaagaaacagcaaagattgccagtgaaccatcagaagctaggagagtgacataggacagattctgcctcacaatcctgagatggaacaaacactgctgacaccttgatttcagacttccaccttccagaactgagagaggatacgttacttctctttaagccctctactttctggtgctttgttatggaagccctagataactaacacacagtgaagcccctgcctcacagagctttacattctagtgtggagcagaaaaggaaatagaaaattaccagagagacatggttattctttatatggtggtaaattgttaggagtaaagaaaagtagggtgaggaggataggaagtgctgctttatatgatgtgacctctgataagatgccatcaggagtgaaagaaggtgagagattgagctttgtaaatgtctgaaagaagagcattataggcagatgcagcagccagcccatggctctgaggaagaagaatgtattttggttagaagaactgctaagaggttaatgtggctgaattggatggagtaagggagaggggaaaggtaggaggagtgtggtcagagaagaccacatagattgtataggtccattttagattctgatggtgactttggcttctattccagagatgccatgggagggatgttcaaagcaaagggatagtgtgatctgatttaagttttaaagggatctctctgggctgtgtggaaagataacataggtagggagcaaaggtggaagcagataaatcagggagaagccttctgtagtaaaaccatccaggtgagagaagtggttggcttgaaccagcttgttggttggtagaagacagaaggggctacgtgaacagttagacaaagcattgcatatacaaggaaatgcttgacagaggaatggagacaagttttctagaggatgcttcaaggagtttccacttaggagaagcaccttagaggggacattgaatattagcactggaaggaagttggtgcagaagagaatttggcttgctgtagccatgcagtcatccagagcgatgaggttatcaaccattacaagattcactcctcccactcatgtctttgattgacatttctggtccccagcgtgctgctctcacattttggtccctgcaatgagcaaatgaatttcgtttcctctagtgaaagctcaatttgaacaacgggggaaaggttttatttaaatctcctacagctttgaactcatcttggattcaccatccatctgtcaacctgaaaaaagaaaaattacttaaaacaaaaattcaaactgaattgacaccaaataaaatatcaaatgctggtagcaagaatgatccaataggaagtgcttaacagcatgaaagctcaaaaattggttgaaaaattatttgcatctagctgtttaaatattttgtttagttgccatacaaattaccttattttagactccaaattttttaagagcaaaaaaaaaaaagaaatttaaaaacacagaagtttaaaataaagtaaaatgtaaagataacatgactttgagttcagtgagattgtatctaattttgaaatatagtaagttaattaaatagcttcttaattttgcagcaggaacaaatctcagtctacaaaatgtggggtggatgtgtgataactggccatagacatactgaatttaaagggtaaatacttgaaacctatcacctgagtttgaatcccagcactttttttacaagttgaggaaatttgttaacccatgcttcagctgcatctctaaaatgggaataaaaatagaaccgactttataatattgctgtaggttttcagtgagttaagtcatgtaaagtaaatagagtgactgccttgattaagccttaaaaacttaagctgtattattattttttattatttaaatttcctaattttctatttaaagttacatttcactggcttagagaaaagtgtaaacacatttcgtttatctaattccagcttcctgggatttgcatcaaactttgggaagaggcatgacttacacagggcctaagcattggtgctcttggaggacacggagcttgggggttgggcagattctctgtggtattgacgatccttgtcttattttcttctcattggagcaggaggcagggaaagaaatgcatggctcagcagcagcagcatgcatatttattgctgaaggtcttctcccagacattttggatttttttccatttgttaccttcacctagaaaatctttagtgtattaatctgcagagggcatctggtcctttgtctataccatgaaatctgttattctgtacctttatttcttctgagctaaggattggataacctcaaatatttttctctctctctttttattgccaagatctcccttccctaaggcaatggaagaagacatacaggagagaaggaactacaaataagagagatcaccttgaacaaaagttcgaaagtccatgaagctatatagtttttttctttttgaatttgttcatatgcttgatctgtgccaggaattgtcctgaaatttatgatataaagaaaaattaagcaaatcatttaattaaattgcgtactgtcacttggagaagatgggcaagcaaactaatgactataataattagagtggagtgtgatgagactcagagtatgtagatataaaacattccacaaaagaccatttgtagtagtgaccctctgtagggaaagatatgcattccaacattggttttacttgaagtgagttgataaaaatgaagcttaccagactgcatatgagcaaggcgggactttggaattggaaagggaatgtggggatagcactggagaagcaggatagggctgcagcaacactgatcgacagggaacactaaacaaggtggactgttttctgtgggtgaagtctgcgtgctttaacaaagtaagatacttcgtatcttaagaaaattagcactcgtaagtgggagtcgaacaatgagaacacatggacacaggaaggggaacatcacacaccggggcctgtcaggggcgtagggggaaaggagagggagaacagtaggacaaatacctaatgcacacggggcttaaaacctagatggcaggttgacaggtgcagcaaaccgccatggcacatgtaaacctatgtaacaagcttgcacattcagcacatgtatcccagaacttacagtaaaaattaaaaactaataatagtaaaataaaatacagctattaaaaaaaaagaaagaaaattagctcacctctctgaaactcagttttctcatctataaaataccatcactagcaaggatgctatgaggatgagggaggaggatgtcattcagattcccaaacctataatacgtagacggtagtttcaaggaaggatgtggattctattcgtttgccttggtaatggctaagtgatgtaaaattagaaatttctaaattcatccatacgtagcttctgacatctgcagaccacatcgaaaaggttatcacactaacggggtgccgagtggagtaattatttccagtcaaatatcttgaaaatacatatagaaagttaccaagactagaggagaaggtagtgggagcatgagggtaagactttaaaatacctggattcaactgagttcccaactaattattagacaatagtttcctccattgcagtcaacccttcctgatttttttctttttaaaagaagacatttaaaaaatctttttattggtgtagtcacttgcatgatggcctggtttgactgaggtgttagaatagggtaaggcaggattttaccttcctccaacccactgtaggtgatttgcaattcaatgagcaataaattatataattccaaatatggagtgtgtgtatgtgtgtattttaatggacatcttttggaaatgcccagaaaatctggaaaattatggcgccaaagatggcctgaatgaaagcattagtagaaattagtataaagtttttgcttagtcttgctttggctatgtgggctcttttttggtttcatatgaattttaggattgttttttctagttctgtgaagaatgatggtgatattgtgatgggaattgcattgaatttgtagattgcttttggcagcatggtcattttcacaatattgattctacccatccatgagcatgggatgtgtttccatttgtttgtgtcatctatgatttctttcagcagtgttttgtagttttccttgtagaggtctttcatctccttggttaggtatattcctaagtatttttttatttgtatttttttgtggctcttgtaaaaggggttgagttttttatttgattgtcagcttgattgctgttggtgtagagcagtgctactgatttgtgtacattaattttgtatcctgaaactttgctagattcatttatcagttctaggcattttttggatgcatttttagggttttctaggtatacaatcatattattggcaaacaacagttttacttcctctttgctaatgtgggtgccctttatttctttctcttgtctgattgctctggttaggacttcccatattttactgaatagaagtggtgagagtgggcatccttgtcttgttccagctctcagggggaatgctttcaacttttccccattcagtatgaagctggctgtaggtttgccatagatggcttttatgacttcgaggtatgtctcttctatgccagttttgttgaggtttatacttcccaaaagtatacctacaatgagaaagaaaattggtgggattatgtgaaaagattcaataagcattcacttgccatatgctattggaaaggcactagaggcggaagaaaatcacagttcacctaattaattatgatatagatatattgctactagttataatccaaggcataataattctacatgctaaatggagatcccatcatcattcatagaaaagtagagcaggtaacattatttcaggaaatcagggatagcttctggaggaattaggccttgaaagatgggaagagtttgttagaggaagacttgggagttcatcaggaaaaatatttaagctaatggaatggcaggaacaaaaagatgatgtgtgttgtgtacagggttctatttcggggagtgtgagcagaacagaatgcttggagttttggggaaaaggggagaaagggtgttctttattttttgttgtttaatctttcagtgatttcctatgaaagaactttaaaatgccagataccttctgcatttgaagaatgattttttttcacataagcagacaccattgtgtaaaacaaaatatagtaaacaaagccaaccaggctttaacgatggacaagcccgacttccgaagctacagtgccttgccactaaatatgagcctgacttgaagagtagttaacaaaatcattttttaaaaatgtgagttcatcttgtcttacctcacacagtttcttgatggtatcagttgctgcctaatttcctgagtcctaacctaagagtacctcctcctggttagggtctcaacttgccttcttagaatgaattcttttcactacattctcaccatggatcttctcttttcttaagtcatcagtaaagagattttctaccatatccactacattacagtatttggctgctctagatgaatatcttgggcagttggtccaggacttacaatcctctaccttgatcctttgggtagcctttctgtttggttcctctgtcttagacagatgggcaggagagggttcctcttctagtatcttcatgtcacaaggtgttatccatgacgggaagtgggggtgagttgtctttggcgtttctttagtggagtgcagctcagagcagtgtttcttaaaatatgtccatcattttgtgaagtggtattcgtcatgatgatattgcaatttaaattcagaagtgtgaataaaagcatggtattaaaacaatttatgaaccaaggcttcaatcattagtatgataactgcaaacacatatataaacacatggctgtttgccatgtaatccttctttcttttctttcatttctttctcttgagtagactttcccctattttattctaacccttccatctattaaccgtaaactcgtctgtgtgtcttttttttaaagagacagtgtcactctgttgcccaggctggagggcagtggcactatctaggctcactgcaacctcgacttcccaggctcaagccatcctcccacctcagccttcctggtagctgggactataagcacacaccaccatgcccggctgattttcgtattttttgtagaaatggagtttagttatgttgtccaggcaggtctcaaactcctgagctcaagtgattcgcctgcctcagcctcccaaagtgctaggattgcaggtgtgagccaccacgtccagctgtgtgccttcattgatactaatgtagattgaagctgaaaagataggaataaaaaaaaaacccagaacatgtggcagctattacaaagattgattaaattgatgttgttaaggggaaaaacccttaaatagcatctatgatagcattttagtgaccatggaaaatttaatattttttctgatagtggaccacttactcaagtgaatcctaaattatatacaaaaattacgtaacaaagacagccatgagttggaccctgttggataataatctagtgttttctagattccagaattgtagattcaagtgagtagaattggaatgtactttgatttgggggagttttctggaaacaattgtggatatcgtttttcaatattgaatgagttgccaccagaggtgtcatgttgcttggaatcatcaataactcagaagtgacagagaacagcctgggtatgctctgaaagacatatagatgtcacatgttgagagcttaaccagatggcatttttactcatgcaataaatacatattgagtgtccacaaaatgtcagactctgtgatagggtggagcaatgaaagagtgagaaaaagaaacaactacccttcagtcctgggatttgagattttttcccatcctaggaatctaggaatctacaaatatgaccttcagttttacacagaagcttctttttttaattgttaaatggggctcagttgcactactttacagcctaattttaaaaattagataaaaggatatgtgggctgggcacagtagctcacgcctgtaatcccagcactttgggaggccaaggtgggcggatcacttaaggccaggagtttgagaccagcctggccaacatgggaaaaccctgtctctactaaaaatacaaaaattagctgggcatggtggccgtgcctgtaatcccagctacttggggggctgagacaggagaatcacttaaacctgggaggcagaggctgcagtgagccgagattgtgccattgcactccagcctgggagacagagcaagactctgtctcaaaaaaaaaaaacaaaaaaaaaaaaaaaaagaaaagaaaaggatatgtgtagaagtgcccagtgacaaaatgcaagaattttagaaagttgataaaacatgagaagatcctgggagacacatgtgaatctcaagagcaggaactctagtgtattcacctgtacacagttactatcactagtgacagaaacaatagagaagtattttctttctgaatgaagaattcttctctataatggtaattcctattaaatcctttaatcggtaattgcaaaaatggaataagatttcagtctaatgctccaagatgtttgcactgcaaaattctacccattatttagtcaaaatccatctctgaggagcagcctaagcaaatgatctctccttaacctcagttgaaaccttgtcatgctatttcactttgcttagcagagtgctcatcttgagtttgctgtataccaatatgggggtgcagtctccatggctgcctgcttctccccatcctttgatacaaatcaacattcttgtttagagaatgataagagattattaaattcaggtatcagcagtggagttttggggaagaaaaataaagagatcatgctctgtaacacagccctgagaaaggagactggggctgtgtgctttctagaaaagtggttttccctcctgcatgactgatggcctgtctggtgtgaggctgaccatggtaataatgtcgtgacctactctccacagtggaaaaagctgtcggttctgatgtgatggaggttgggtgtgggagattgggattacagaactgcagtggccacagatagactcctgatttagtcacataaaacaggatgattttgtgtaaaactgacatttagtttattttacatatatggaaggaagactaggaagaacataaaacaattagcaggaattacttctaagagatattgagggaagtatcaatttcttttgattaatatgattttttacattccactttttatttgtgaagatgtataaatctaaaattaaatatacatgcccacaaaaataaaattatgtatttagtgacttagcgtaatttcataaagggagcatgaagtttagaatcagccctgcaattaacatcctaaattttgcactaaggataaaatgcttgaaaaaggatgaagtgataatatccctttctttttaggacagacattctaggattgaacacagctcctggaaaggagcttttctgcctcgctcaccaggagtgtgctcacactcttgacagttccctgtgctcctttcccactgtgggatttaaggccaaagagattggatctggctgccacactccttcctgctgccatattctcttagtgaccatcaaatgtcacgtcccttgttgacacagcactatgctctggaagcctttgttgaaccctattccgctgtcctttgacccttttactttttgaaatgtatatattctgtggatcccatgttttgttttctagcctgcagcttccctcagcaactacagccagagccagccccattcccttctcccctcctaatcagaactcttaaagtctactccagtctttcttagcttgcctgttttgctgtaataaactgggacatgcagggcaaagtctcaacacaggacatctcagcatcttgtccatactcttatctcggagcaagaacacacggacccactgttgatacctgagacaattatatttctttacaatgattttagaaactactagagcatgatgagctcaggtgttatggttagcaaatgtggaagactcaacttgccttcctcacaaaacctatttgctcttctcagttgcaatggactacctctacctggagtgtcaccagtgaaaaagttacttgacagggatctgtgggtggaatctacagagtgacagatttcagttcagttattaagataaagcatttataactgacatgttttgtaattgagtgggtggtttgctccacattcctatggcaagtatttcccagagcaggtaccttatatcggtagtcccactgggggctccatgacaacgcagctgttttcatcaagttggaaacgctgtcactgaattactgcccatggactctccacatacctaggagggaattgggggattcttgcagcagagaagcccatttaacttcaaggcagtagtctaacttttttttttttttttttttttgagacggagtctcgctctgtcgcccaggctggagtgcagtgacacgatctcggctcactgcaagctccgcctccccggttcatgccattctcctgcctcagcctcccgagtagctgggactacaggcgcccgccaccacgcccagctaattttttgtatcttttggtagagacggggtttcaccgtgttaaccaggatggtctcaatttcctgacctcgtgatccgcctacctcggcctcccaaagtgctgggattacaggtatgatccaccgcacccggccagtagtctaactttttaaaacacagatcaatattttcctggaacatgcttttccatatcccatagaccagggtttaaatgatcacacttgggacccttgtatgatcagaatcatctcgctccgttacttttagcacagggctgatgcttaaacccacattgtgtcgctttgtcccagggctgcattgcagtgagttcctgttcataggctgggtgacaagttaaaggtggcatcctgagattggaatcaaggcaacgatgttttcgcttgctctgttgcagcctgcccacctcgggggaatgtcagcagcccctttttgtcagcatataaacaagaggttttgaattgttcagtcatagagaattgtgaatgcgttagaaacacccaggccttaaacttcggttagtggttagataagaagaaaaagttcaagggaactattgtacaatgcggcaactatagttaataacaatgtatttgctaacagaatacattttaaatgttctcaccgcataaagataagtatgtgaatgcgtatgttaattaacctgatttagccattccacaatgtatacgtattccaaaatatctggttttacagcataaatttatagaatttttgttaattaaaaaatgtgggcttcaaatttccaagtgttttccaggaatttttggtgttaaaaaaaaacattcattttgtcttgctagacaggtacctagtcctaaaatcttaagaatgtttcagctctgcagcagagctgctggcatttattaagtatgttgctagttgtaagatcatttggttcaatgttgggcatattttcagactcaacaatttatattttgcttgctgtatgtgcaagcaaataacttcaactaggccagcctcgttgtgaagaaatttccccggtaaccaatgaagaaatattaatgatttgccagttggtctcctcggagacagataacagttgtcttcctttgtctgccccgctacctagcttatatttggcacttcatcaataaactaggggtgagaaagtaaataagtggtgcttctactctgcctgaggatacttgaaagcaacttgttctcttaagtggattaaataattcctccctgaagatctcattacttgataattttgtaaaaattagctttttctttataggaagggggtaagtaaactttgagtataactggtagctaagagccaagccggcctaggctccatcatgttcccagcacttatgggcaatctggtttagagaaagttagttcccctctccgtgcttccgtttcttaccagtaaaatgaacattacaacaatcttataaattgctgtgagataatatttaaagcagttcctggtacgcagtaagtgctcagtaaatgttacccactactgtataatccaaaggtgggagtgttccaaaacaaatgctaattttacaaataaaaattttggagtgttaaaaggaaggaagttatatgttcaaacatatgtatgtcatagataaaatcaaactgtttttgcttaaactatgtgcctcttcttccaccctaatatctgtgcagtacttgacacatagtttgctgagtgaatgaatgaactattaattaattaatcttcacctgtatcgcttgatgttttcctgcaggcgtgaatatccctgggcatactgcttgctttgagaaatagccagtgaagggttatgagaaatagtgcgatttatgatctgtgtatgactcaaatgacaaaattaattgcttttttgtcatctgttcttcatggattttcattaattcttccatatgaaccaaatcctgtcttaaaccctgcagtaatgatcacggtgtttaacattttaataaaacgatggaagcatgtatgtgtgtgtgtctgtgtgtgtgtgtgtgtattcatgacaaagaaagtgagagagagagaaagaaagagaaaaataatttacatgagagttaactttttatttgtatgtccagtggtgtcagttgccatgaataagctattataaaaaattaataaataatttcccattaaaatacaaaaatataaatgccatcttccttgagagtatttctgaaagttaaaaactctaataattggataacttttctgttatgttaaaagaggacagtttttctttcccttaagaagattcctacttatcctattcagtgtttgaataatttccaaattttgatttctgtctctgctactggtcataaacatattgaggtttcaaaacattcagattggccctccattaatcaaacatgccactcatttcttagcacaatctacagattcacaaagcccgatgctccatatcccttgtcacatccggaggcagagcattgaagttcatggaagaaggaagaaagccatgcctgagttgcacctgccagcaaaacagatgacaggcagccaattctgagccatctcagctgcaccggaaagttcttgttcaaacaggctgtatctaaagactttctaattaccctctcatgtcatggaacacctgtggtccactgtttgagatcctctgctccctgatttctgtacacttgcctctcctggtttccttcctgcaacctcctcttctgtctatatgaaaaagtttagtttttattcccagctgttcacaaatattatttttagtgtaatgataggtaatccttattttaaatgtcacaactctagtctctctccaatgtcctaggtaccacagtcaggaagcttcctatttgcataagaatgaaaacatggtcttgaggcaggataagtaaggttaggacccatacttacttgtcctgtgtgtaaagctcagtgggccacttttatagctggctctttccccttgcaccctcaggcatcaacacctaactcttttgcaagataagcggtcctaccgaataccaacagactgttagatggttacaagttcctgatactcagtatgggcttggggaagagaacaaaagtctgttattcctgatgtaacttccccagcaccaaaagcacaagaaactattagctacaaatttctgcctgctgggcactgagagaggggcagagactcctccagtgtcccacaggcatagctagactcaaggtttagcttatagtaatatttttctcattttaatatcaaaaaacaccccttagatggagattttatatgctaatgatacatatgatatgtgttagagcatgtagatcctgagtgtatgtactaaccacagatccacctttacatacttgacctcaccagtattttatgaatatgtctgtacagtttccgtaaaggaaattcccttcaagaccctaggggctatctctgtctttgagcagcccactctgcctctcagattttgagagctaatcccaagtaagagtagacaaacaagtttgttgcacctcactttgcaatactttcgctttgatataaacttctttgtctacacttacttgggattcgctctcaaaaccttttgtgcagagaagtcaacgacctgaacaaggctactgacaatagtcttgccaaattttctacaaactccattcttctttatttttattttattttattttactttaagttctgggatacatgtgcagaacatgcaggtttgttacataggtatacatgtaccatggtggtttgctgcacctatcaacctgtcatgtaggttttaagccccacatgcattacgtatttgtcctaatgctctccctccctttgccccttaccccccaacaggccccagtgtgtgatgttcgcctccctgtgttcatgtgttctcattgttcaactcccacttatgagtgagaacatgtggtgttcagttttctcttcctgtgttagtttgctgagaatgatggcttccagtttcatctatgtccctgcaaaggatatgatctcattcttttttatgactgcatagtattctatggtgtatatgtgccacattttctttatccagtctatcattgatggatatttgggttggttccaagtctttgctattgtaaatagtgatgaaatgaacatacatttgcatgtgtctttatagcagaatgatttataatcctttgggtatatacccagtaatgggattgctgggtcaaatggtatttctcgttctagatccttgaggaatcgccacactgccttctacaatggttgaactaattacactcccaacaacaatgtaaaagtgttcctatttctccacgtcctctccagcatctgtcgtttcttgacttttaatgatcgccatcctaactggcgtgagatggtatctcattgtggttttgatttgcatttctctaatgaccagtgatgatgagctttttttcatatgttttttggtggcataaatgtcttcttttgagaagtctatttatatcctttgcccactctttgatggggttgtacaaactttattctttgtattgcacattctctccctcctaggagcaagtttatgggtccatggcctcttcatccagtgcacattttctgcttttccattatagcacttattacaaagaatgaccatagctttttctccatggtctctcattcatttctgagctacctgagaacaagaatcctttctttacatgaaagtgtgcctgatatctatcaccatgtgtatgatgaccacagagtaagcagtcaagaaatgccagggaaataaatgaatgcatctactttttagaaacattgtcaccatctttctttatgtaattaaatgtgaacggttcataaggcaaattgataaggatagaaagtagattagaagttaccaagggctgggaggagggatgaatgaggaattatggattagggggcacagagtttctgattggggtgatggaagaatttggaaaaaaggggtggtggttgtacaacgttgtgaatgtatcaagttaacaaaagtaatggcaaaaaccacaattacttttgcaccaacttaataattaatgacactgagtcatgcacttaagcatggttttaatgataaattttatactatgtatatatatatttttttccaaataaattttttaatgacctatttacaaacacaaaaggcattgaaatctgggtaactagatgcatgttttctaaaaggaaaagcttatttgctaaataaagaattcataaaaggaagctcagcaattagtcttggaaacaattacaatggtagcaatagttttttcccttattctcacttcagacaaatattatggcaacagaaaaaaatgttaattaatgcaatgaattttaaaagtgaatgagtgaataactgaatgattaaaaaaagaaccatttaaatagaggaacatctgaggttgaatacttgggtccagcccagtacagttcattgctctgctgatcaggcagatgttagctggtcaggatggtttgcattctatatgcacgtagaacagacatggacacacatatttgtgtttggtaggatgggctgtcaattcgaatagtcatggggcttaacggtcagatcaaccaaattggtgccctggaagtgtctcagattttgtaacctatgtaagagttttaatctcactgaagcacagttttctcatctaaaaagtgaaagagagagagaaaaaagtccaacatcattgctttttttgtggaggtaaagtacacctgattagggcctggcatgcagaaattccttgcttattcacttttatttttattatagaggttcaaataaattcatgttgaacaaatagttattccacataaaatattatgcattctgaaaagaatattagtgccagatgttcatggtataacaatttttctttttctttcttagctaaatttatacttagcattcttcatgatgtatgcaatattagttcatctaaaatctaagctatagctcagaggctttgggggaaatactcatcagtgttcagagtaactctactgttggtgatctgtaatgtatcttttctaagcaaacataggggttaaaattgaggctgtgccttgccttggagggttagtcttatgagcactgatttccatgtatagagctttttctaacctttttctctttttctcttccccttccttccatgctgactttggtgtagcagaccacttggggattgaattcatgggtaagactaaacaatttgctcatttaatatcctggaaatgctaagctttatgatgtacatagtgctttccttctccatctggttataattgaaatgtctcattatcagatgctattagtaggaaaaaatactcttgtcgagttttcactaagtaatggctcaaaatgaaataattaactacttattggaaaggcaatttaatgttaaatgcagtgtctggaatcatacagaagttgtatttggctcctggctttgattatttcctctaattctcaattttcatatctgtaaaatagggataataataggttctattttcctgcacatgtaaattgcttagcataacgtctgcaacatggcaaacactcaataaaggataaaaagcaatggtttttaaatgtcagtttttaaatttttacttctaagtccccttccttttgtgagatgattcctttggatacattttggtatcaattttagtttggagtgtgggctattaaacatttttattcacaaaattaaaatgtttcctttaaagtatttgcagtgaatggtgtatgtttcaaagcattagaatgccttccatgggcattgtttttatagtcacagataactgcattcaaaattagacctaattctctgagtcgatggttatacattaaatgaagaaagaacatttcataaagttcaatatgcatcgtagtacatggatggaaagacactcaggatttagagttagggaaattgagaagatctaaatttgaatcaaaattcatctgcttctttggattctattaaattcagatttttttctcttgtataatgtggatatgaatacttgctttatacatgaatgtttattgtgaaataattatatacttacttgtattaatttatccattcacccattaattcagcaaacacttatcaaagtgttgatttgggatagctttgacatatttgagagacgttaagttggtggttgtattgttggaagtgttgagagttaattagaaatttgtgaaatgtctttataccggaattggtgttcccagttgtatggtattactcattattgctccattctctggttattacatcatagaaaaggcagacagctcaattcctgcaggcttgcggttttgttggatagatgtgatgaaaactcagaaaaccaatgagatttaggatgttattcaaatgaagcgcgatggaatgtgagatagttgtagaaggaagtgaaagaagaatgaccgtttcaatgaaatcaattagtagtcatcatgagagcgcttgaacaagctggtgtgatgaagagattatagtcatatggcagattggttgattttgattttgaagatggaggagttataggagatgacaatattcaaagcattcctatgagtgtaaataaccaaactgaggttgagggggaaataatttgaaactagaggtcaaggacttgagaggacatagttttggataagttgtctaatggatattccagttactcatgataatgctagggttgggacagagagaaaaaaaatgttggttatatgccaaagtttcccattaatatgataaactatactggaatttagtagatgacaaggaagagtatagttaagggtaatgccagctgcatcaaaaaatagagcccacgttattataatggctcaaagacggtagcaatttatttcctgatactactttttcttgtccaaggtagatgtatttcctgtttaaggtagcaaatgactagttttattcaagtagtgaattagagatccaggcttcttccatcttttggtttcaatattacgtaggtttctttgttaactgcatctagccagcagattgagaaacagaacagagctgatgcatacccaatgcttaaaagactgatctacaagaactcatatcactttttgcttaatgttctattagctagagctaaattacatgacttcattttgctgtaaaagaggctgggaaatggaaccctgagagaacagaggaaatgcatttttagaaatctctgccactgtgtgaatggcataaactttaaaggaacaggatttttcataagagacaagagaaactgtacgttagaagccaggaggacagatctccaatgttgaaagtgagaaaataaaaacagctcttgagacaggtagaggaaaatgagacttttcaggcaagattcaagtttcagctaaaataggagaacaaaaataaagagtcaaagaagagattgagaatgcagaaggtgtgttgcggaatgtggatgagcaatttcactaagccaagtggagggtataactggtggaagaggagtagatagctgagtcatgggccacaaattactgaaaatcatgggcatatttttgcagtaagaatacattgttgagaagggcacacaatttgtaccctcctcattcgctaatgatggcagtgattcgtagcatggaggtgtgagcatcagtactcattttgaataaaatgtgccctgggccgcttgtccaagagcaatttgccccactagtctgtggtgattgcaggctcagtgaggctttataagttgttcagcagaatgccctcaaatgcaggaaacactgcatagttggtggtgggactaggataggtctagatccccagtgtagccatggctgtagcaaactaaaattgccatgcaaattttaatccgtgttgaaagaaatggaccagtctccatcctgttgtgcttcctattgtgtctgaggactgccagtggcactggtaatttatagagttataatttgctatagatgcaatctatgtattaagagctctgttttggaattcatttaaagaaatgtagctactgacacaggaaaaaatagtagattgtcatgtagttcatctacatgaaccacaagactaaggtaatagtgagttttgcaaaagatagattctaatcatagctataagacctcatggggaatgaattctcagtgggtgactatttgactccaacggtagaaattttcttggagggaaggggttggggaacaactcagagttcaagggattggctggtatgcatatagataatggcagctaaaaaaggattgtttgcagtagtgaatagctttataaatttagtgaatatgctgttttcactgacctcaataattcacccccacagattgttctaattgaatatgtaaaattctgtttgttgctttgagaacaatattctcagatttaacttttttatttttattttttgagatggagtctcactgtattgcccaggctggagtgcagtagcacaatcttggctcattgcaacctccgcctcccaagttcaagagattctcctgcctcagcctcccaagtagctgagattacaggcgcctgccaccacgctcaactaatttttgtatttttagtagaaacgggtttcaccatgttggccaggctgttctctaactcctgacctcaagtgatctgccctcctcagcctcccaaagtgctgggattacagacgtgagccaccacacccggctagatttaatttatgattatagaatccatatgggtaaaattccttccactgaaagtgccatcatcccaagtaatatgacatctctaggtatgaattcagctgggaaggggaaatgtaggcatagtctatatgtaagtttaataatgtcagtttattgttgtgccaacaattaatcaatgctagttctatttgtgtgtgtgtgtgtcaatttctttaatagacttgattttcacacagttttaagttcatagcaaaattgagtgcaaattacagagatttctcacgtatcttctgtcttcaaacatgcacagctacctccctaatgaagatctcctacaatagaggtacatttgttacaattgacaaacctaaacctacattgactcatcattatcattcaaagtccaaagtttacattatggttcattcttgatgctatactttctatagattcagacaaacatattatgatatgtatccattattatattatcctacagagtaggtttactgccctaaaaatcatttgtgttctttctagtcatccttgcctttccccaaccactggtcttttttatttattttattttattttattttattttattttattttattttattttattttattttgagacagagtttcgctctgtcacccaggctggagtgcagtggtgccatctcggctcactgcaagctccgcctcaggggttcacgccattctcctgcctcagcctcccgagtagctgggactacaggcacccatcaccatgcccggctaatttttcgtatttttagtagagacggggttttcaccgtgttagcccggatggtctcgatctcctgaccttgtgatctgcccgcctcggcctcccaaagtgctaggattacaggcgtgagccaccacacctggccccactggtctttttactattgtcatagttttaacttttctagactgtcatatatttgaaataataccttttgtactggcttatttcacttagtaattttctcatgtgttttcattgcttaatagctaattttttgtatttttagtagagacggggtttcaccgtgttagccaggatggtctcgatctcctgacctcgtgatctgcccgcctcagcctcccaaagtgctaggattacaggcgtgagccaccacgcctggccccactagtctttttactattgtcatagttttaacttttctagactgtcatatatttggaataataccttttgtactggcttatttcacttagtaattttctcatgtgttttcattgcttaatagcccatttctttctagagctggataacattacattgtcaccttttgaaggacatcttagttgtttccaacttttgacaattatggatataattgttgtaagcatctttgtgcaggcttttgtatagaaataaattttcaactttttggtgtaagtaccaaaaagcatgactgctgggtcatatgggaaggatatgtttagtttttttagaaactgccgaactgaattccaaggtggctgtgccattttgcattcccaccagcaatgaatgagagttcctgttgctccacatggtctccatcatttggtgttgacagggttctggatttgggtcatttcaataggtatgtaatggtaactcactgtttcaatttggacttcactaatgacacttaatgtggagtattttttcatatgcttatttgccatctgcatattttctttagtaaggtgtctgccaaggtctttggcccattttttaatcagtttgttttcttattgttaagaattctttgtatttttgaaaaatgatcctttattagatatatcttttgcaaatattttctgtcattctgcggcttttccctttattctcttgacagtatgctttgcaaagcagaaattttcaattttaataaagtccagattataaaatcttccttttatgtattgtgcctttaacactgtatccaaaaagggattgccaaatctagtttatctaaatactctcatatgtgatctgctaggagtgttatagttttgcattttgcatttaggtctgtggtttattttgagttaatttttgtgaagagtgtaaggtctgtgtctaggtgcatgttttattgaatgtggatgtcaagttgttccagcaccatttgttgaaaagtttatcttttctccattgtattgtcttttctcctttgtcaaagatcagctgactatattaatgtgtatctattctgagttctttgttctgttccattaaactatttgtcttttttttttttgccaatactatactattttgattactatagctttataataagtattgaagtaaagtggggtccgtctttcaactttgtcttttaatgttgtgttgacttttctggatctactgcctctccctataaatgttagaatcagtttatgaagatacacaatgtaacttcctggaatttttattggaattgcattaaatctataaatgaagttgaaaagagctgacatcttgacaatattgagtattcctattcacgaacatggaatatctcttcacttacttgggttttattttttaagtctttcattagtgttttatcattttatttgtatacatcttttattttgctagacttatacctagatatttcattttgggggatgctaatgtaaatgctattgtgtttttaatttcatatcatatttgtttattactggcatctaggaaaattattgactttacatgttaacctagtatcctgttacattgatataatcatttatttgttataggaatatttttaatttttaatttttgttaacctaagcaatcaggtcatctgcaaagacagttttacctcttccctttccaatctgtgtacattttgtttccttttcttatcttatttaattcgctacaacttccagtatgatgttgaaaaagaacaatgaaagggggcaactttgcctcgttcataatcttaatgagaaagctacaagtttcttatcattaaaaattatattaggtatagatattttgtagatattcttcatcaagttgagaaagtccacctctatttctagttaactgagagtttttaccataaatgggtgttggattttgtcaaatgctttctttaaatctattgatatgatcgtgtgatttttttagtctcttgatgtgatggattacattaattattaatattgaaccaactttgcatacctgagataaatggataaatgtcacttggttgtgttttccattgttctattttaattagttacataatacattttttctcttacttttattattcttgctttgagcaatatgactttcatttattcttgaagaacacagggtcacaaggaggtaatgatctgaagcacacgtcttcttcccaaatctttatactctcaatgaccagctctattagtgagcttactgatcagtctcaaaaccagaatacttcatacagtttaacaaattcctgttttatagcaggaaactccaagtcatatgctgcaagagttctatatttaattgacatacatttgtcacatttactatatgccagatgtataagatgttggatatgcagatatataatacatatctctggatgtccaaaacctctaaaactaaaaagagaaagctacacataagtgaggtgacataataagtgctctaaaaaaagtttaggcaagatacgatatgaaaaaaaaaaagaaagcaattgaatgggcttggaaagttcaggaacagctttccaggaaaggggacacttaagctgagtatcagccaaagtggataagctatacttagtaatgccatagtgcaaatctataccggccccatattgctcccacattaaagcaagacttgctatttcagtctttcttcctgtatctatcagcttccgagagtcaccactttaggaccggaaagaggataacaacttcagtaaaaacaagtaaccaaaaaggtttttgagtagatttattaattttaaggagtgattatcccattgaggaagccatgccaaacctaatgtctgtaaaactgtcaacattcaacatgatttttcatttatattcccgaatttttcttaatgatgctcctgggattggtaccatggaaatttcaacagcaaatactgatctgcaatacggtgtcagttaaaaaataaagttaactgacataattagagcagaaatttggaaatgcacacagaagcagaattgtgtttgtgaagtttttgaaacaaagagagttgatagaaaatcagtaaccaaaaatatatatcttaaattcatgtcttaacctcattcattcattcatgcatgagggaaaatatagatttttacagtcagatgtttgaaatttccttaacagtttgaatagatcaagagatataattgacagacttcttcataagcctaaatattcatgagtgatgtgagaaacaaccaatcatttagtttaggcagttggccaaagggcatgtcagactggccattttggaaggtgcaataatcacgaaggatttcttatctaacaaatatctagctactgtgtgtgaaatgtatctcattaggtccttttgagctatttgttaagtggttatttttctaacaatgtcttgatgcatttgatgttccaggcatcaaagatgtttatatgaaagcaggtgcaatgccatttgaaaatgtattagcaagggacaagtagagttgaagattatgtggaagatctttaatgcaaatttccttcattctcatcgggtaaacgaaatgaatgctgtcagttaaatattttgtcggtgatttgacattgtttttaggatagcataatatatttatgcaaagtattgtttgagcaaattctggtgtaattttttaaatcaaaagatgtatagaacatagaaaaataagattcttaattaaaatcttaaaaagttattataagataatctttgtattttttaagttaaaaaaaaaaagaaacagtgttttccatatggaaggcatagaaatgtgttgtactcaacgtctgtgatataaattatatttataggtttagaattgatagaatattacttcaaacttgatcgtatattgggtattctttcatcctcttgtgtaaagaaaataggctttagtgtattttagtgagcactggggataatctcctaagaagtgaccagtttaggatcctgtttagatgataggaagtgggcttttttcttcttagagctaccctgcatattgtaaatgacttggtgtttttcctttaaatctaacaggctcatatgtcagccaaatgaattcatatttctgttctagtttgtgaactggcgttagagatagaactgaggattcttttttcctaagctgaagtctctgaagtagacttatttggaaaaaaaaaaaaaagcattttcattcatttgaatatattatatttctgtatagaataaaatggtaatttatggatatatatgcatagatgtgtgtttgtggaggagtgccattaaaagagtttagttttgctagtgtgccctttgccatgttaaactacgtgagaaatcagatatagtggaaaaacaaaagttacatgatcctttaagctctcaaaatgagtgaatgaagtagtaactatttatatcgctatcttacaaatgacaaaacctgactactaattagctgaattatctttctaaagagcaacaaagtagcagataggagttgaattcaaatctgtctttctccagagctcttgaattatttaggtgactaatggatgagcaatagggctccatgtttcctcaaagaggttgtactcttgcagtgtttcaaatggcaaagcagttctgtgactagtccttagttttgaaggtaatgttttctgaatcccttcatgtcataaggatcttggccagtaactcacaattatccaagctacaagcaaatgaaatatgaaccagatcctgtttatagctatatattcagaattataactgccaacagtataaaaaggaccacttagctggtcattgtattctctcacatggggtaatctacagaagttgtattgtattgaaggttttgtggtgagtacagactgtgttgaatgaagtcatttgggtggttctactgtacatgccattggggtataaaggccttactcatttatctcctctgatagaaaacatttgccaaattaaatcatgatttgaaccatctctccactggctcctaaagattctattggagaagtatttaatacttacacaatattgttttctcatttattttattttaaggaatatgaccactctctttctattttttatttttcaaggcagggtcttgctctatcaaacaggctggagtgcagtggtgtaatcgtggctcattgcagtcttgacctcccaggctcaagtcttcttcccattttaacctcccctgtagctgggaccagaggcatgtggcaccatgtgcagctaattttttatttttttgtagagatgaggcttctctatgttgccaaggctggtatcaaactcctgtgctcaagagattttcctacttcagtctctcaaagtggtaggattacaggcgtgagccaacgtgcctggcccactctctccctttacactttgattttctgttggtttattttaacatgggcttcagtacatgcgctgttaatcacaagccctccaagtattttgttttaacaaagttatctttatttgacatggacattccaaagactcccaagccatacatataaggataatattttggcttaattattaagagtagtcattaacacatattggtacctcctattgggagaagtaaaagtgtttacacaaagtcatgacaactaagtcaaataaattcaattctgagataattttcgggtgagattaatagtgttcagtgatctttgaaaatgatacaaccaaaagatgtattgaagaagtatgcagatctattaatcatgatttctacaaagaagaacatgagtatttctgtaaagatgtttttggacaagattttaaaatcagctaataaaatttgattggtagacactgaggaaagtattgaactattggcaaaagcagtgctgttcactgaagaataacataagaccaatacatctttgctagattaatagtataatattttccgtaaagttgttaaataactagattggaagtttctacgtaggtgtgaatatatggactttagcaaaatcttgggcagaatttcatgaatttcttatgtaatatggtgaaacattaattatgtagtaattatatagtgatagatagatttggggcaatgaattctagttgaaggatcaagaccagccatgagcagagcttctagtttcttctaaggaaacatttttatgaattgaaataagggtatagcttgaacatttaccaaattattgaactttttgtaaaaagtgaatgcttctttgtcagagagcaagtctaacaaaaagcattggacattggacttatcaaatcagacacagaataatctgatcttttagtcagtatcaagttgattacttacatatgccaaatatctcaactgcacgtgagttggtagtaggttctgaaaatctgggatgtgctaaaataaagggaaataaagagcaacagtgatgttcagattgtacttagaaagtaattctcagagagagccaggcatggtggctcacgcctgtagtcccagcagttgggaggccgaggcaggtggatcgcttgaggtcatgagttcaagaccagcctgaccaagatggatgaaaccccgtctctaataaaaatacaaaattagccaggtgtggtggtgcatgcctgtaatcccagctacttgggaggctgcggcaggagaatctcttgaaccctggaggcagaggttgcattgagccaagattgtgccactgcattccagcctgggcaacaaaagtgaaactctgccaagaaaaaaaaaaaaaaagaaagaaagtaattctcagagttatcagagaagttaaaaaattgttttttatatccaattctgccttacagttgcttcaggagctaggataagtcagcttaatagaaaggggaagaaaggacaatgatggaacatctgcagatgcagcaaagtgaagatgatacaggttcttctcaataagcagagtctgtctgctttgtgggctcatgatggttcagccagtcagaatgtgttgagcccctgtgagagctcaggccttgtaccaggccagctacaataagtcaaatgagacagactctcaagaagttcacagttcagtgcatagggcagactttttttttttttttttttttttttgaggcagaatttctctcttgttgcccaggctggagtgcaatggtgcaatcttggctcactgcaacctctgcctcccaggttcaagcaattctgcagcctcctgagtagctgggattacaggtgcctgccaccacacccggctttttttttttttttttttttttggatttttagtggagacagagtttcaccatgttggccaggctggtcttgaactcctgacctcaggtgatccacgtgcctcagcctcccaaagtgctgggattacaggcatgagccacagtgcccagccacatgggacagacttttaaaccaattattgcaattcttgcaaaaaagacttaaattgaagttttgttttgttttacaaaaggtcagatgaagatgtcccaaacatatacaggatattaatatatgtttgacacacatgaacataaataggagttgagttcacatacatgtggaaaacattaggttctgtacctctactgcatagcttcacaaagtcttaggtgtattctattcatctgtgaatcttggagagaaatctattgtaggcaaccttttttgaactatttgtccaaaggagcatatatgctagagctacggtttagggtaaatcctgggataaagggagacagaggaaggagcacccacatacatcagaatagttcgggccatttttaagtgaaagaataaaaaattatatttctacagttagtagctggagaaaggaaatatgagagagagggaaaaggaagaataaagggaaataagagatggaagagcacatttgggaaatggcaaggagtcccagaactggacaaacttgatgtagttggtgaaggggccagagcagattatgaccaccctatctgccctttgaaataagtataatcttatctcttgttgaagaagaaaaccttctgaggtttcaagcagggaagtgatgagattttcttaaacagcttactctgtcagtagctgtgtgcagagtttgcctgaaggcactgatcgcagaatcctagctaatggaacaaacttgggattttacttcaaatattcaccaaatgctagccctttaagcaaccctgtggacattagaaggataaattttcatttagtctgtgccagattcagagaaagcggcaagtgcagaatgcctggggaggcagtgagatgagttgcaaagtggaccttgaactggtcttcgaggaaagagcacttgatttttatgggcagcgatggaaacatcctaatgaagatgtcagcgtaaacaggacgaggatgaggcaatctgtttggaaatactggctctcatcagcaaagggaatcacattataatttaatttggattacatataactttttccttaaaacatccataaaagcataccattcccctgcatgaaactttttaatggatttagaatgaaatctaggcactatctgctgccatgccaagtcctccatgatttggctctgcctggcaccctgaccactcctaccacgttattattctcatttctctacctaccccagggcctttgtcctgcctttccctcagcactagctattgtacttatctgcacgtggttgattccttctcataataaataattcaattaaatacattctgtaagagacttagcctctctattttatgtacttcctattttattcatattaacttcttttgtttctccactgcatttattaaaatctaactaatttatgtgttcacctttttctcatcagcctcttcactagaaaataagttctgtgatagtagaacttgcttgttgtggatctccagcccaatgcttagcataattataaaagctcaatgaatacttatggaaataacacttttaaaaataaatgtaaatagtatatgtttttcttaactcttaagttgcttaaatgtctaaaacgtataagcaaacccacccatgaaacacaagaccatgcaatttagttctagattaattctcaatcagcgatcttctttcttgagatttcctctgcttaagcagtagcatataaaaaatggtattaatctaatgaagactttttttttttttttttttttttgagacggagtctccctctgtcgcccaggctggagtgcagtggcgcgatctcggctcactgcaagctccacctcccggcttcacgccattctcctgcctcagcctctggagtaggtgggactacaggcgcccgccaccacacccggctaatttttttcgtattttttagtagagatgggggtttcaccgtgttagccaggatggtctcgatctcctgacctcatgatccgccctcctcggcctcccaaagtgctgggattacaggtataagccaccatgcccggcctaatgaagactttttaaagttgaagtttccagttcacttagtagtactgagggttaaaggtgttaaatattaatgtttccaacaggattggaacacagcttagggaagtcaagtaaatttgcttatccagtgaggtcgcctgtcttcatgttgcattcactcttctaagaaggatttcatccctttttttttttttttttttttttgcatgagaattgaagcagaagcttgtgctgtattgaaagtatattgaatatgggctccgtttattgatgaagctttcaagcactcaccagttaggaggcatagaggaaagagaatgaatgttcactattatataagttatgggcatggtaggtgacttcacaggagttatcacattttgtcttttgaagttaccagggatcttaaatatgtgatgtatgaaatcgccataacctgagtgacctaatctttggtttggggaaaactgctcctgtcttcattttagtatccttgggaataccagatttggggagctacctagtatgtattcaagaaagctgtccatatttagagtgcgcacgagtgagactgccattcgtggaagagaaagacatagagcttcagggcacagaaagttagtcttttaaaaaagcctcttaagggaatttttttccactatatatgtgaagaaataaggctgatgaaagtaaaagtaatatgcccaactgataaatagtaaagatgaataataatccagatcaaaatgtctctaaagcttgaactattcccataatccttccctaggagcataatataaaatggtgtgttttctccaaatatgatgatatcctactttgtgctgggctccaagcacactgggccagggccataactacactcaactaggccctcagctgtagaaggtatatcatgggtaggctggccagatttagtcaataaaaatgcaggacacccacataaatttaaatttcagagatgtaacaaatacttttttaggctagatatgttttgtgtattgcatgaggtgtatctataaacatcgtatttgttgtttacttgtaaagccatttttgagtattttatctggcaacccctgctgtagggccatgagcacagtaaggagtggctccccagtgacccacttctatctcacactccagttcccaggaaggctgaattagagttaatatgagcagtgcaggaagataagcagaattaatgaggaaacttagcaaaaggggttggaataagagtgtgctttgtgtcccaagggacagctctgcttgttacacgatgagaattatgcacaaaatactaaactgttcccaaattacctcagcaactatggttgtttaacaaggcaaacacaacctgcaagctcattggttctgggcaggatggatcctgctgtcagagcaactgatgaactattttaaagccaagttcctattgtgagtgaaatagattaacacttcagatatggatgcttcaaaaaacaaatagcagcatgctaacttagttaatgagtttttgaggaagaaagtagcatttaacttaccaaaagatgcagttcaaggctatattaatgaagtaataacagctgtgtctttatctgttcactacccattcattttctcattacattcagactgctaacttcagtcacaaacatgcttgtatgagaatatggggccttttgttcctaccagaaaataatcaagatgtctatcttctagagttgtactgtatcatagaagtgattcaatgattctgcttttctatttctgtgagaaaaaggcatgctatgggattcaagcactgtaataaacacacacacacactgaagccaggtggacatttatcaaattttgacttcatctcctatatgctgtgagacatgggctatctgcctagctatatatctatgtatttatgtatgtgtgtatgtatctatctatatcaatgtccaccgctgatggttcattaatataaagattgatgatgtaacaccccacatatgcatttcttgacatacaggcattcaaactatgtttttcctttcttcatttcctaatgtgctacactgtgttttcctggtttactgagtatgcctgtgtgtccagaaaccctcaaggacagagctgtgtgctttaggagtcttcctcgtttttgcccctggaacagtgccaaatactatagaattttagttgcatcttgccacaccacctggctaacctcatctcatctactcatgcctttctcaaccattcagaagcacgttctcttcttttaacacgccgtgattgtccatgcccgtcttttctgcatgtgatttctatgtgccatgacacttaagacttaccaccctttcctaatacatcgttcatgcagatctgcattcttagtgtataaggcgcttatgtgttctactgtaactttgctagattatggtgtcaccatggtttatgtctgtcttaccccaaaatattgtgaaagacacaaacgacattatctcattccagtctcagctggaatttcaaatcccattgtctaaatcaaatccaggtgaagatgaggctcttcacatgtagttccttaagctttggcaacatgagtagagttttcttgacggtagatgtgttaactaaagagacaattatctgtcccacatacacctaacatgcaatggcagacaagcaaacaacattatagacatttctgctcaaaaaggatggtggagggaatggaaggcactgtccagtggaagaatcgctggtccatagcaataatgtcaccaaataaggcaaatgttgtaagttccttgtttaggtctcaaaagtgatatcacaccacttttgccatatcttatttgtcaggagttagtgggtcaatctcacattataaggagatggggtccttgagggcatcttagagattgtctaccacacagtttcccagagcctttggctagtttgtgtaggacttccatatgccacaaaggcctgtgtcacacattcttttgtgttatcttctcaatactgcctgtttaaggtgggtaacagttactaccaacaactaggaccccaggaaaagctcaggtttaaatacctgacaaaccaatgattacattagctgccagtggatacctctgtgtgggtgattaagactattattcacctgtaaaatattcatacctctctcacaggaatgtggttagcataaaacaaaataatctatttggaagaaaacaagcataccctttctctaaaaatatttacttttataagtttatgatgctctcaatgtgtagaagacatcgtttcaaatgtagttacataatatgttgatgtatgcggaatgtgctatataagaaggcatgcctttttttcttggaaaattatattgtcataaaaagtcatgtttttgttattaaaatcaaacactatgtatttacaggtctttttttgcaacaattgcccaatcaaattcttatttctgtgaataaatgatatattattattaattatacatttagaagaagcctcggagatcagcaagttgaacctgtcccttttagctgatcagtctgtatatagagttgaaatctgtctgtctgtatagcacaatgtcatgaagtcatagattcctggaatttaatctttgctcttttaattactagaatttgggtacattaattttcctgagtctcagtattcttgtctgtaagacagggctaataatagtacagtgtatattctaacaactcttgtaattgttgaaaagaatttccctagtcaacttatatttgttctctaatctgctccttcacctcatagtctctctagtccttcaagataattatcttggcttctctctaagtcttatctccttagtcatacttattatgatattattttcaactctttcttttcctgtgcactattttcagaaaagcttcggtttgtcattaactcttcagaagttaaaacctatgtcccatggtattttgaaacttagttgagagaatgcatgtcatacttccagagtagctcatatgcagtaaatgatccaaagtatcctgattcatcttttctgtcattttttttcacaccagagttgtgtctctctccaggagatagctttgtaaatattttgctatagtttttttttttttcctcttccccagccacactttacagagtggagatgatactatgcaattctgtctatttaaaatgtatttatattaagttttcttggtatggaaatattgcttatatttatcttgtaatttgttttggctttatagttgtataagagatataagcaaaatgggtctacactttgttttacctgtctaccattaaaaatttcccttggggggaaaaaaaagatgtttgtcttacataactgcagttgttttatatagcctttagtcaacaaaaatatcactcttagtggactaggctagaactgtcttttagcaacttctacttatatatttatgatgatttacttaattgagatataacactttacatattgttctaactttcgtcatctttgttttttctgttccacagataaaaaatacagatatttttgcatattgaggaaataaagtttaaaaatttgacattccttgagccaaaagaaatgtggaaaatatttttcacctttctgttttgcctgattaatgtttaaattctcatcaaaactaaagtaatttttaaaatgccattgttggtaagatctcacagtttggcaatgcccacagttatgacaaacacagaaaactggtatttctgtaaaattgacgctatactattaaaacaatgtgacattatcccctgtccttctttaaccagtagcatacttgtgttttctacttctaactgatcattattttcccatcatatatttaccaaattttacctagagttgtagaaccaaatggttcttactcttcatactgcaaagacatgaatgatgtttggtaaccaaagaaaaatatatgttgcactaaggattagtgttcttgctgttgccactggtctgaccaatgaaaagatggtaatgtgtatattaaagttcttttctctcatatatacaaaaaatattgattctgtcttataacaactggaacttttccagtcattctgtccttcagatatacacactgacaagtgaggacatactgagatgggcgtggatgtcccttatttattgtttgctgtagaaatggaatcacaatctcagaactacagttccagatttcaaaaccttctttttttggcttgatgttataataggaaaatatcttcaatttggtaaagtcaatcttctatccaagaagaataatcttctgcccgtaactacaacttttctaaatactctttcttttttggaaaatgtatggttatgtatatattttactacagagaacacaatgagttttctaacacaattgtgacaatagaaggcaaaagcatgatgctcctgtagctgaaacaggagcattatctttgggaaagctggagttttctctgaagactacagtgtgcctgctgggtcacagtgattccatggtccggggagattgccttattatgcccaacatcttaggaggctgacatttctgtcaagttgccattgtggaaacagcaataggatatgaatactattatttattaactataacaagttgcaatttctgccagtttataaagctacttgagtttgtaaagcttctggttatgtaaaagtgagactgaagtaattaagaccaaatataaattttgtcctatgtcaatacagatcttcaaaaaaataaaatacaaaatatacattgtaagccaactgcaatgtaatcactgtggctttcagggtttgaggtattgaagaattgtaggccatctttgggggaaagtttaccggatatcatttggaaatgaatccccttttgagacggggtttcaccgtgttgcccagtctggttgcgaactcctgagctcaggcaatccgcctgcctcatcctcccaaagtgctgggattacaggcgtgagccaccgcgcctggcctatttttttttttgtattattatttttttagacggagtctcactctattgcccaggctggagtgcaagggtccgatctcggctcactgcaatctccgcctcccgggcccaagggattatcctgccttagcctcccgagtagctgggactacatgcatgcgccaccacccccagctaatttttttagtagagacagagttttgccacgttggccaggctggtctcgaggtcctgacctctggtgatccacccacctcagcctccctaagtgttgggatttccggcgtgagccacagggcccggccttatcaaagatttttcacgaaataaagataatttcatttccttggtttcaacagtgtttcatggaagagtgtattattttcttctcctattatgtgtcttcttttcatatgccctcaatttcccttactcatttatcttttacaaaggcacttcctttctttatttggagctcaaccctcactagcagtacctcgcatatacatgagtttgaatgttcccttacaggaagaggaatgtatttttggcaattctgagcctttttataaagttcagattggatcgatacgttttgcagctttttttgactaaatgaaaactactttaaatgcattattttacctatccgactgactttgtgaattaatggaataatacgagcaatacacttgggctttggagcttagtattgtcagtgctatcgatttgtttagaatatttccatgaatagtttataggatcctagcacactgtggctgaacggaccttttgagacctttcagtctgtaatccagattcttatacttactgagaactgaggctgagatgctacaagacatgcctacattttctcaagtaaagacaaagttaggtttcaacagcaagcatttcttagctatctgctactaggcatagtcttatcatttcacctttactgcttttgtctttaaatgacaaccagttcagatcctcaattcttatagcccaatgtatttatacctagatagaaagatagatagttgtagtccttcttcaatgaggattccatacaattagccttgaggcttaatgacacccttgtaaaatcgttctaattagcaaagatgcattatcacagaagcagttcttacccttcggaaatgtctcgggaaatgtctcacgcagtcattattttgatctggctaaagatgcagtgtagcaagagtggctaggttctactcctagacgctgtcatggccttgttattttcaaagggtgtttgtaagctcctactaccgtgctgcattcatctgtgtgtccctcatgcccagctcagagattaggatagagcaagctcttaaatgttgctggacaattggattttcataagtcacttttaatgattttacatacccaagcatcagctccgattacgctgaaagtgtgatgctcctcttacctagatgacatttaaactcccttcatattgaaaaacagaattatctaaacaaaaaatatggttgaaagagtttatggcaaatagaatttggctgtgaattatgttttccaatccctgctgtatagagcaaattgttagaatcagcatttataattgagtttcaactaaatgctttgttttataatttgctgtgaggtaattagaaaaatgtgcatgaaagcatgacacgtataaatcacaggtatattcatctgaagtattttgtgcagtttatatttatagctcattctgtgaagctaaatccactgtattgaaacagacaattaaaggaaggtaaagggactattttcccagcaattgcaatgtgctaggcatgatgccaggcactgcacaagctctatctccattaatcttctctaatgtaaatattgccaccacttcacaaataaagaaactgaactatgtataaaactgagcttaaggggattaatgaatatattatttgttgttgaacatatgcaggtctaattaaagtaattgcaagttatattaaaagaatttgtggtagagacagaagttgaacccagtgctgactggcactctagttattgttataaaggcaatttgtattattgagttactttgaataatacacattttacatttatttaaataaccatttaatttgtaatgataagtttacagattttttaaaaatagaaacatattatggcatcattgtgtatcaaacaagggctatttataagagctcccttggtgtgcttttattttccttgtctaaatggagccagatgactagaaattgtggaaaagcatagactggttcaataaaatcgaacctggagacaaatccaattctatactctaacacagccatttgtaaagtgtgttccctagtgatattaagaggtgttttgtacacacacactcacatagcaaacattaaaaataaataaatggttacatatgtgcatgacagaattccatgatcaaatatgttgagggattcctgggttgaagaaaataaagcatttgttttaaaattgtgtaaatgctcatatccattgacttgaaaatgtgcctcgtgaagctccaagggagaaatggaatttaaaaaatccccagaccttctcatcacaaaaatctcttttacaagaaacaattgttaaatcttggagtgtaagtagatagcatgatacatcttgggaaatgcttattcatttacttattaacaaaagcgtatgagcacttactgtacgccaatcattttataggtattgggaatgcagaatgattaaaactgacaaagatttctgcccttgtggagctaatattctagcaggggagactaaatataaacaagacaaagaagtgaaatatgtatgactgattctgatgattcttaagaaagaaaaaataaaaacaagcagataaaaggctggacagtgtcaggacaaggagttgaatttttaaacagggagccagggaaggcctcactaagaacgtagtattttagtggaaattgaagttaaggaacaagctctgtggatttttaagggaaaactttccaggcataggaaagttgaaattcaagcgcaaggcaactgtgactggagcggaatgagcaaggggaggagttagatgaggtcagaaaggttaccaggacccagatcgggaaggtccttgaaggttatagtaaggaatttggttttgagtgaagtggggagcccttggagggctttgaacacaggaatgacaaaactcggtattagagctgattttttgagaaaagccaggtgtggttgagagggagggtaaaacaatcaggtagaaggctactgtaaggatctagaggagacacgagggtgacctgaacaaagatttcagccctggtgaactccaatcggattctgaatctatactgagagagagtctgctggatttgttgaaagagcggataccgggtttgagagacagcaatcagagatgagccaggatttcgacttcagtaactgaaaagatgttttgaacttcttagaatgaggaagaccttgagagaaggaggtttggagagggaaagttgaatataaggagctaatttttaggcataataatatcaagatgcattttatgtattcaggtgcagaggtggatttggcagatggaatactaaagtaggcggtaaatatcactcagtttacatagatagatcacatggaaattccaaagttagaatggtctagatttaaatagctaattctcatttacagaaacttcaacgtgaaactacaattctataagctaacttgtgcagccctgcttccagaagaaacaaagaaacagaaaaaatcaaaagggaggaaatatcgcctgccccagtcttaagtgattcccattcgttgcctttcctgggcttgaaggtggagttttgagtaaaacagcagcagtggttgctggatgctttctgatggctctacagttgccctgaaggaatctcaataggagtgttccttaagaatcctgctgatgagcagcactccaccctcaccatcttcaactgaaacagccttagaggaatttttgctggtttatagatcttctgttttgacaaagatagctcgtgacatcactctgccaggctgaaggacttctattctgagactggtgacagcaagccaagaaagccaatactctaagtgaatttaatagactctattctcatgctacttgggttgctatgggaaccttattagaaaatacagggactctagatgatctgctaagttttttttttttttttttaagtaatgtaagtggctttatcttcaggaaaaaaaataagttgtttttctaaaattgtgaacatatagagaaaaatataaaaaacctaaatatgttgcttacacatttgttataaaggacaaatccgtgtaaccagacatatcaaggaaaagaacggtgctgattttttaaaagacagtcacttgcccctttctactcacagtacttccgttatctcaaaaccataaccaaaacaaaaaacaacaaatatcttattatggtctttattttcatgcttgtatttagcattgtatcacccgaacaaaactgacttagactgatttattgcatattatatatacatacataatatacattcatcatgtgaatataatttatacattctactgttcatgagcctttggttgtttctagttttaggatattaggaataattctacctttctacattttagtagccatctttgtataaatgtgctcatttctatttagcatcgttggaccataagatatatgtctcttcaaatttaataggtactgccagacacttttgtgttgtggttttgttgttttgtcctttggttttccaacattgttaaaccgatttacatttcaacttgaattgcgtaagacgttctgttactccacattcttttctgcaccttaaatggtccctagtttgtatattttgccattctattttgtgtgtagtgatatcttatttgtctcccctaaatgagaatttggacaattttcgtctttatttgacatttggataatctgtttgtgaagtatctgttaggtttcttattttctgatagatttcttattttcttattgatttcttagagtaattacttatataacatacaacttgtagctttacaataagtttgtatttctggtagatcaagtaaaccaacattatactttttctacaagtgtgtcctagttattcttggcaatttgtatttctgtataattttaaaatcaactctagttatttttaaaaagaaagaaaaaaatgaacttgatttttatgaagattatgttaaatctatagatgagtttgaaaagtattgataaatatttacatattaaatattctaatcggtctgcttaaaatacatattctttctgtgcatggacattgtctacctcttctgtttgggtcctctttaatgttttccaatacaaatttatagtttgaaaaataagaatgaaaataaaataaaaaatgaaatattctaatctatgcttgtgatacagatttctttatatcttctttcatttgtttgtatcttctttcatttccctcaacatattttatagatttctgtctagaggtctcacacatccttgttagatttaccctttgacatttagtttttttgatgttattgtagatgatatgaatttttaaatttcattttatgctcattatcgttacagagaaattcagttggtttttatatattgagtttatagctagcaaccttgttactcttacttattacacataataattcatctgaagatatttttggattgtctataaaatcatgtcatctgaacattaagatttttttgttctctcttaaatttaaatattttattttttcttaatgtctctctgtctgggtagaccatcttttacaatattaattaaaagtagtcatagcaggtttaattttcttattcccaatctcagaatgaaagcttttaacaatttaccttgaattatgattttgcttaaggcttagaagctatctgctattgcagtaagaaagtttcccttctatttctagttatcaaaaaaattttaaaaattataaatatatattgttttactcaatctatttgtatcatatgatttatcctttagtttgttattgtaatagtaaaattgattagttttcaagtgttaaaccaattatgcattcctgtaataaattcaacttggttgggatatattataccttttaaatattgctagatataagagttctatttttgaaagattttttaaattcacgtttataattgtaatttgggccttattttaccatgaggaaatagagatgttgagtactagtagacatttttaggcctaaagatgaaaagtcttcagtgtagccaaaaaaaaaggcaagcgagaaatgaaagaggcaagaggaaacaacagacagggcacaagagattcaaagagaaaacacataaaaggatgttagaaataggccaagcatggtggctcacgcctgtaatcccaacactttgggagaccaaggtgggaggatcgcttgaagcccaggagttcaagaccagcctgagaaatatagcaagacactatctctacaaaaaattttaaaaattagccatgagtggtggcacaggcctgtggtactagatactcaggaggctgaggtggaaagattgcttgaacctaggagattgaggctgcagtgacctgtgatcataccactgcatttcagcttggatgatagagtgataacctgtctcaataaataaataaataaataaataaataaataaataaataaaagttaaaaataaatttaaaaaataaatcttcataatcaatggacatatgcacatacataccaggcaaacaataaccagagtaatgtgtattattaatatcacataatataaaattaaggaaagtttattagaaataagtttctctctagttaataaaatgtttacctaactaggaagataaaaaattgtgaaggtatatgtacctcataacaccacctcaaaatatataaaggtaaaaatatgtgtgtgtatattcctgtaactatgaaattgatagaataaaaaacaaacttaaatatttataacataatgggatatcttaggcacctttcatagtgattgatagatcaaataaataatcaaaaatttaaaagattatgtatgatatgaagtgtataattaagcttgatgtgatggtcacataatgaatgttatatctgaagaacagatactgtttccaggaacatatcatttatacaaataacaacattctagtgcataacacagcctccacaaatttcaaagagttgatattttgcacaaaatactaaccacagtggaataaagttaaaaattaataacaaaaaggaagaccagttatgccttttataatcagggatattaacatatttatagttaattcttagaactagaagtaatgataatggaaattaggatatatttagaattaatagaagtgggccaggcgcggtggctcacgcctgtaatcccagcactttgggaagctaaggcgggcagatcacgaggtcaggagatcgagaccaccctggccaacatggtgaaaccccgtctctactaaaactacaaaaatttgctgggtgtgttggcgtgtgcctgtaatcccagttactctcgaggctgaggcaagagaatcatttgaaccagggagtaggaggttgcagtgaactaagatcgtgccactgcactccagcctggcaacagagcgagactttgtcaaaaaaaaaagaataaatagaggtgaaaatacaaatacttcatattgaaatgtctaggatgaagctaatgccatgtttacaggtaaatttatgaacttttcttatattagaaaagacaaatggctcagtgtaataaaccaaaaattccaccaaaaaagttagaaaaaatgaatcatagtaaaccaaaaagacagaagtaactgataaagaatagaaggaaaaaatgaaataaaaattatcagataaagagaggatcagatgagacaaaagttggttattaaaatgttaccctataacaaaacaaaacaaacatcaagctcagttgattttggagatgagttctataaaacgtaccagcaacacaatttcaagttatacaatctctttcagagaattgcaaagaggaaacatcccaaaatttattttaaatgcatggcataaccttaaagacaaaatctgtcaaaaacagtacaagtgaggaaagagcaaattgaacccagcaaagtataaggagataatatcacttgatcattattcctgtaatgtaatatttcttccattttagcaaatgtactaggtgtaaatcaccacattaaataataaaggagaaaaaaatgatcattttgatagtaacaaaaaataattaaataagcctagcatatattttttttagatgaggaaaaactgttaggcaaagttttacacaattccttttaaatcagtggggaccaatagttttaaaagggtaagatttaagctgctctacaaatctacatataaaccaatttgtgtcaacatctcccattttctttgtcatccgtaataccaattttggttctcaggttaatatgtcatttttcctgtttgagatttttctcctgtacttagagtcctttaacttctccactgcctctcacatctttttgtataaatttgtatttttcctattaagactcaattcatctattaccttcactgagaaatattcccgagaacccttaccctgaattggcacaactatcaggctccataagttttgcctctacaataattttttttttaactttaagttctagggtgaatgtgcagaatgtgcaggtttgttaaataggtacacatgtgccatggtggtttgctgcacccatcaacccgtcatctaggttttaagccctgcatgcattaggtgtttgtgctaatgctctccctccccttgcccccactgcccgacaggccctggtgtgtgatgttcccctctctgtgtccatgcgttctttgttcaactcccacttatgagtcagaacatgcagtgtttggttttctgttcttgtgttactttgctgagaatgatggtgtctagcttcatccgtgtgcctgcaaaggacatgaactcattcttttttatggctgcatagtattccacggtgtatatgtgccacattttctttatccagtctatcattgatgggactagttttatgattcatttctatcatggcaatttctatatgatattgctgttaatatgtagatgctattcccactgagctgtgaactactcaaggcagggggtgtgtcactcatttcagacctccagcccttagcactgttccccacatcctgagggcatccaatacacctttgtcaaatgggttgaagagttgagcttagaaatttacattctttgttcctgggaaggctaatcatagagaaggcataaacatgaaacattaaacaagagagtttaatcatattttaagattatctgagaaaaaaatgaaagacaatccagcacaataacattctttttttttttttttttgagacagagtctcgtctcgctctgtcacccaggctggagtgcagtggcacgatctcggctcactgcaagctctgcctcccaggttcacgccattctcctgcctcagcctcccgagcagctgggactgcaggcacctgcctccatgcccagctaattttttgtaattttaatagagacggtgtttcaccgtgttagccaggatggtctcgatctcctcacctcgtgatccgcccgccttggcctcccaaaagtgctgggattacagacgtgagccaccgcgccctaccaataacattttatttctcattttaatgttgtaaaataaagtgagtgacagctggtttgagtcaccagtctgctgtttactggctggcctaatgtcatttccttgttggtaaattatagataattattttactatagcattaggttgttgataggatcgaatgaaatactgcagctaatgtactcaatgcagtggctgagacatggaagtgcctctgtggtctatgagtattatctttccaatcttgagaggtagtagaaggctacaaagtgttggcgtttgagtggtgtttaagaaatggagacaatttgaagagaaagtgatttgggggtttgcaagtacagtttacatgatgaaaggtaagaaaagaatgaggctgacatttattgagcctcttcaacatgtgagttgtttgaccaggcatcttcctgacatcctaccagttaatgctcacaaccagcacctgatgaggtcctaccacaccatttactcatgaaaaactgctctctggaagttatgaagcacatgctgaagatcacacttggtggaaccaggctccaagcctgtctgattttatagctactgaacttcttctggagatggctagaaaaggaggaatcaaggatctgtagaatctttcctgtgcctggcaaagaaggatgaggctgactgtgaatgaatttgtggatatagataaatagctattttccatgaaatacctgtttattgttgtaggacatctaaaagcagattttaatgagaagaatgatgttttgattttctacatgaaaataaatgtgaacattgatatatgtaaaatatgtaagtgaaaacctttgctttttgaaaaattaaagtcagtacctcaaatgtggcttataagtcagcaaaacaacctgaaactagatttaatatcatgtttattcaacaaattatatggttagtaatcagtatgaaaggttgtttcttcccagtggactgtagcagaaactaacctcattacatttgagaaaccatcattgctagggactagttgaaatgtctgtctcagaatggcaaatggaattgcattttaaagaaacttagagtctttattgttttcatcactaaaccccatactcatgattagcaggagtcatttgtcagctgaaatcatactggttcttccattttagtttgatccatttccatccatctgctcatgagagaagaaattcggtttggtgaaggatgtctggaaaatgcgaagaccaccaacttgggaaacttttatcatcacgatacactgtgtatgtctctgaacaacaacatggtttgaatgaagcaaaatagagacttaaaatgtaactaaatgtacaattgtatgaatgtgtaagtgctatggaagaagaagcctttagaagttctcaatatttactgcagaatttcaaaatagtcttggattaaacaccttttgagaaaaaaatagacgttcctaaaccataatctaatgcttgagagaacagaataattttcagtacaagtaagtttaaatgctaaatgagatgagatggttaaatgtccagatgaaaggtaaaatacattgttccatcactgaattcacagtaacatgcaaaagatccatcttgaatataacctgcccagtccctgaaacaaacccaaggcttctttttttttctgatcttgatttcttgaatgcatagtgcttttaaagaactaacatgtcttttttgttttgttttgttttgcgatgcagtctctttctgtcacccaggctgaagtgcagtggtgggattttggctcactgcaacctctgcctcccgggttcaagtgattctcctgcctcagcctcccgagtagctgggattatagatgtgcgccacaatgcccagctaattgttgtattttttagtagagacagggtttcaccatgttggccagactggtctcgaactccagacctcaggtgatccacccgcctcagcctcccaaagtgccgggattacaggcataagccactgcgccctgctagaactagcatgtcttaatgtgttaggtaataatagaaatgtttcattctctaattaaatgatgaggtgattaatagtaggttaaagatactgtaattatatattgagtaggatactattaatatatgttcacttagcacttactataaggaggaagacataatgtagccttacagcccagcaactagggacccttccaacttcaggtcctcaatcttgtgcagcagacctgcagagtctccttaaagggaggccagatgtgccagagagtcagtgcccctagagcaaccctcaaccaatgagagatagcagttgataggtaagttccacagcctcttgctccacattgggacaaccctgagtctgtccacactggggctgagccctggttgcctacagtggtcagccacttattaatccatcctttattggtctctcccttttttaactcccaaaccccctcacagtgttccttgggatcaattcctaaatccttctctcagagtccaactaaaacgtggaggcaaatatgtaccaaatagagctcatgttctcccttcaagaccacccttcaggtgtcaggagcctcacctggaggctccctacccagatggtcttaaggtgctcacagggccagctcagatcaccctttccatgggttctgactacacaaaagtagatggtgtgccacagtccatacccctaggcccaaaatttggaatgaccttggacatccagattgattgcatacacatttgcatgatgctcttgtcaagaggaaatcagagtgagaagggaaagggagcaggttctgggcctgggcctccatttgcattcttgccttggaattctgagacattaggtgtggggctgaatagaaggccaggagttttaccttttttttttttttttttttttttgagacagagtctcgctctgtctcccaggctggagtgcagttgtgcgatcttggctcactgcagcctctgcctctcgggttcacgccatttttctgcctcagcctccctagtagttgggactgcaggcaccccggctaatttttttgtatttttagtagagacaaagtttcaccatgttagccagagggtctcaatctcctgacctcgtgatctgcctgcctcggcctcccaaagtgctgggattacaggcttgagccaccgcatctggccaggagtttttatttcattggttacacgcagtgaattattggcaggtgaccaaattgttttggtctttaacgacttcatgtgtataatgagggatgtatctaaatttattcatagggtccctacaagaccataggttctcattgtcaaagtcatagatagccattcttctgcacataagggacactaaaaagtacccccttattttctggctgggatctctgaatgctcacactgtatgatttggtggggctctcatgccatctgttctaggcctctatttactcttggtttaaagaacctagagtccaaaggtgcatgaataatgcaagtcatattttagataaaataatacagataacaactgtacttaacagtatgaacaaaatcatgcaaacaaaaccaaaattgatatctgaccagggagaaaggacttaggaaatatatcagtacataaatagtgaatttttatttggatgtgttgcaggaatgtgcgtagtatttttttctctgtgttttaactttttcctacctgtgcatttcttagaatcagtagctttgtcagcatgcactcagagaaaccatggaagcatatttagtaataaaattgttattcttatagacaaatataatcgtttaggaactagcatggcccttttattctcaaaactagcctcagtcattgacgatgattgctatttaaaggtgtagagggaaatatttggggaattgtctgcgtatttcaaagtacccttaaaaatttaaatcagacaaactggataaattagacatcctcaagtactaataggcaggtctgctctaagaatagtagaaggtagaagaaattaatggttacgagaggggtagaggaaattaaagttaataactaaagatattgcactagtttgtttttgcattgctataaagaaacacctgagacttcgtaatttataaagaaaagaggtttaattagctcaccgttctgcaggctgaacaggaaatgtagtgacatctgcttctggggaggccccaagaagcttctaattatggcagaaggcaaaggggcagcaggcatctcatatgatgggagcaggagcaagagagagtggtgtcacacttttaaaagagatctcatgagaagtcacacagtatagcgaggacatcactgagggaatggtgctaaacaattcatgagggatcccctgccatggtccaatcacctcccaccaagccccaccttcaaaattggggattacatttcaacatgagatttgggtggggacacgcatccaatctggattgcatatcctcatcaaaatgtcaatacttttattttgatagtgttactatcattaactatgtacagtactttattgttaacaatttttttctccagcataatactgtttagtatgacattactgtaaattattataaatgtcttaaagattattaatttcagaatgtatgatgtattgcctttaaaaatgaacatggactttttaaactaatataggtataggaagaaataaaatctcattccttgacaaatactaataaaacttattattgagaataaaataaacagtacttatattatgtcagatattctgctaagtcttttgcatgcgttatttcattttttaaaatcacagtggccttatagggttggtataatgatccccattttacaaatgaagaaaatgagacccagacacactatacaatttccccagattcagtcagaaaataaatggtagagctgaaaatgtactcacatcctaaaggctaaagcctttattatgataaaactctgtgagatgacacacattttgatgactgcattagtttaaaggaaatttttttcatggattttgccttcgttttgctttgttttgctagtgaaattggtcctgctaagcagtataacacaaaatgagacctcagatctaaaattcagagagctctaaaatcaccaaactaatctaataaaagaaaatacagattttaccgaaatttaataggagttagttaatataaatgtttgaaataataaacatccccagaactatctaacagcatgtgttataatgtccgtttgaactgattttaaatgaatagaatgtttttcattccctcctgtactgagagcgcttgcctttgagtgttttaatatgtcagggatcatttatattctcaaaaatatattacatttatttggtttcattctttatctttcaaccgtgttttaaatatttacaatttcagcaaatttgaattttttttgtctttaaaatgcctctccaaaggttttgaaatctctatgtgtttgtgtgtgtgtatgtatggcttttattggccactgatccaagtcgctccaaccttagagaggtggaaaaatggtgagaatatggattatgaagggacaaaaggatggaagccaaaaaaaatacaattcataaaaggtcctggaatctttcctacacaaatgcccagaggcctcctcattctcaggtactgctctctgcaggatgaacctttcacctccactcccatccagctctaggagtgatcctccagaagaataatgggacttttagtgattccctgtagccaatagccaagcggcagcagaatggtacatacagaacaggtgaagatttcttaagcaccagcagtgattagaacacagtgggataaggtcaaacagagcagcagatggctaaaattatatgtgaaagtcgttttataattgtgaagaacttggtggtggtgcacaaatccacattctgtgttattcaggtacctaacatcaatcctcctggtttggaagacttcagatttcacagtttagtaatcaccatgctttagcaatggtacttgcttttatttagcggcactgtaataaagattactcttaatttaaagtataccccttatatagtagctttttcgtttcattttaggttttaatatatttgttactgtagctaaatacataaatggataggtaaatatatagctagatggatataaccaaccgaaagatacatgagaccatttttagtaacattattctattattgcatatatttcatatactatgtacatcatggacaaccttgatgatgagactcaggcaatctgattaaatattgggtttattcacagtttgtaaatattgggtttattcaaagtttgtgaactcaggaggacacagactccaaaaggaaagggtcagtgctccaaagagggaatgtttgaagatcatttaagcaggaaagttctggggaagattaaaaagattacattatttttccatagagggttagtgaatagttacaacaatttgcttagttatatgcagcatttctttttttttgaaaggcatatttaacattctatattaaagaaagacgtaatagtcaaggggtcttttgtctcagtcaaggggtctttttttatgtcagggccacgtggtcttagccataaaaaaggaaattcggaaggaagttaatctatttttgaaaggtcagtaattaaaagttcaagctgtgtgactcagtttccaaagtcaacaatcttcagggcctaataacttttagaaactccaaatagacacactatccatttgctttcacatcatcaattatgtatttaaaaagaactttgtttctgtatacattattatatgtattatatatgtgtatatacatatctgtatacacatgtatagttgacccttgaacaacatgggtttgaactgtctcggtccatttacatgcagttttttacaataaatgtattggaaaattttttggagatctttgagtttttgggtttgaactgcattgatccatttatatgcaattttttataatatattggaaaatattttttggagatctatgagtctttaaaaattcacaggtgaactgtgtagcctagaaatatcaaaaaattaaggaaaagttaggcatgtcatgaatacataaaatctgtgtagatactagcctatttcatcattaactaccataaaatatgcacaaatttactataaaaagttaaaagttgttaaaacttacacaaacacagaccataggtggcatcatttgcagtcaagagacacataaacaaatgtaaagatgtagtattatgtcttcactgcataccattcactatagcacatactgtaaaactgtaataagtttgtagttgcttcttgttgctatcgtggtgagcccaaatgttgagcgtgtttgcttaaaatacgtgtgatactaatcatctccatgtaagcattttgcctctccagtaaattgtatatccagtaaaaagtgatctctctctcttgctgttcttatatatttttcattgtgtttagtgcagtaccttaaaccttgcataacaccatgggacccatacaaagttctgctagtgatgctggaagtgctcccaagaagcagagaaaagtcctgacattataagaaaaagttaaattgcttgatatataccgtggattgaggcctgcagctgcgggtgcctgccatttcagacacaattcatcttgtaaacagatgacataaacttatggtattgataaataaagcacagtacttcaaatgtattttctcttccttatgacttccttaagaacatttgcttttctctagcttatcttattgtaataatacaatatctgatacatataccaaatatgtgttaatctactatttatgttatcttaaggcttctggtcaacattaggctattagtaattaaatttgatgggagttaaaagttatacctgaattttcaactgtacaggggtcagattccctataacttccacattgtccaaggctcgactgtacattacatatatatatatatgttataaagaccagcaagatttcagacacaagcagtgaagtctggacttacagatgtgttgactctggttactgtacatgtcttgtcatccctttggcattcaatcgtgtcactttacattatcagcttgtattttaacatcttctttttttcaacaaatatgcagaatagattttctaaaagttcagacatggtacaagacaagcttgtccaacccatgtcccacaggccacatgtggcccaggacagctttgaatgcagcccaacacaaattcataaactttcttaaaacatcatgagtctttttgtgattttttttagctcaacagctattgttagttttagtgtattttatgtgtattgcaagacaactctttttcttcaaatgtggcccagggaagccaaaagactggacacccctggtgtaagagatggtggcatggtaatcacagtgcctctttaatgtgtcatggatactcattaatcattcaacaacagaaaatggttggtctcctttgccctccttaaaatgagacatggaggatgagcagcatttaaaccggaagaaagggagcttggtggggaagatatttcaagcaaaatgcatcaaagtgaagttctagaggtagctaagtatggtttatgcacatctttgttgaaacagtattcctcaatgttttttatatcatgggaaacagaaactatggtttgtgagatttgaaggaatacatagaagcatatcttaggcatatgaatgggatatgcctatatcaaagaacagtaatgttctttgctagacctctgtgttagagaatcatatacatgaacaaaaatattaggaaatcaaaaaaagtagatggggaaatgatttcagagggtttcaatggtgataatgatgtcaacaaaaatagcatcgactatttttccctgaggagcccaaagtatttctgatacatacttccagtcatagatggaactgattgagcacaagcttaattctaacagaaacaaaatgtgagaacttgaactttaaaagaacattttctatcctgtagaaagcatgatctaaatttatagtatgcctgacaagtgtggatttttcacaattccctgaaatacagaaaatgaatttaattaattgtgctccaaggctgagttcatactttggcttgaattcattagcaagtagcattttaaaaaggaagtttggttgtgggtgtctgtccaatttggaaatatttacccatggtctttatatttaaaatgtgtttttgattttcaaattctgcagattatttatatccatatgcctgttcagtttggtgtattcataacatggttcacactggccttgtattttctcagttcactgtatttatcagtttctctccgattgtcttaatccatccagtcctccattccatttcctaggcattttctccaaagccttaatttctttgtcttcttcttctgtgttgacagtgattattgaaagctttttcttcattccaccaggttacctgttcagaaattgggcttctaaaataaggcatttagcaccaaaatctctattatttgaatggttattccatgttttcactgttttgttgtttcattgttttttgtttattttgttacatgtttttactgaattattatttttatgaagttcttcgatagtgcaaaaatcttggggaaagtgtgcttccttttctttaaatacactgtctttcagaattggcttttactttccttgctttctgaacctttattttccttcattcctgctaacccccgacctcccatttctttcttcctttctctctagaatttaaatagttatcaagttgcttcttttcatttgctcatatttatttaaagggcagctttgtctgaaacttctactcatctggatgcactgagggattgctctctttgaccctatccaagatattaacaatgtttctgtcttttccctgggcttcatgtggatgctaattttgcttctaaccacattcctgtatcctgagggcaatgggataggttagaggctagcttagctgtggccatgtcatatgtcaatctagcaagactagattatctttaccaaaatcttatcaaaaatatcaaacatggccttctgcacccagctacgtgctatcctgctcatacagcttcacccaatttctaaaactcagcatactgctctagaactttctgactccactgagctcccatagcagtatgttggggcttctcttcttaaaactattccctcaagtagtctcctcagctctaaaaattgagtgggaaaaccagcaagaatcttcagggctttattcccttctgctcctcaatattaaccctgtggagaagacatggggtttgaggcttcacacgtcgtatcataatttatactacttttcatgacagcaatgttaaaataccttgtggcataagatcacactctagtccttttttagttgctgctgttgaactttgggcttttattaaaacattaatttctataggtgttggggaataagatttgtaacctggctttacttaatcatctttatccaaaaaatattttaaaacagcaacagtttgacataaatgtagcctcagaattttcaatattagaagaataaataagttataaattttgcctatttctatattgccagatagaattttaagaccacaagacatcatgaaatttaaattaaaacatgtccagtaggaaaaaaggttttgtcacttaggtaacatgactaacatcctaatatgctttctcgcatttttttaacataaggcaatccattgagcaaatcacaccaacatttttttttcatcattcttaaatgtctctcttctagaaagggtgaagcatataaaatcaccttgttattaaaggagttaagaaagaagtctgcagaaatcagtttggaggaatattgaatctagtgttttgttttttcatagaaactttagaaggcatgatggtgattatacacataaggaaataaagaatggctgtattaggtcttaattagtgattataacagtggcaaaataacagaagttgaatgggtccttacatctcacttcagagaaaagtgtaaactgcagtcaatacaaactgatttgggttagcagtcctattattctcagttgcccagagaatgaagaaaatgttctttatcccatcgctaagagcagctacagtgaggcatcctctcttggggcgctgtctacccttcatgcctctagagattcttggactctttgctgtcttcactgagttttagttcactgggggataaattcttataatttctttccaggtttaaaataatacctgcctatatttatttgacattatacagaaaaattttggaagatcttcttatgtaaaatttatattctgtggagttgaagctatattatgattttataattttctggaatatatcattttaccccacttttaacagtttgcgaatcatggattctattgtagtctcctcctttctcaagtcagttcacatcttgacaaattttttattaatcaggattatacaatgttgatccagtctgtctggaggctattaagaagcattaatggaataaaagggatattaatttatcatcaattatttaaatggactgtttcttaaaccagtctgtgttttaatataacttgggcctatggaaccttcgtagttgctattaaataagaaatatatgtgatgtatgttatacaacatataaggtatatattatctatacacttttcatttatttcaatacagaaggttttccatttaattccacaggtattttttaagcactaactgtatgcataggtactgtatataaatacaatgtaagtagaagctgcagcccatgttttgaggatgtgaagtctacatgtgtagagcaaatgtgtgaaaattatgaaaccatttaaatatatattgatcaaagcatgtaggcaatgttttgcctgtcttgaaagcttagaaccttagcctgacttatgaaacttactagatatttacccgtgggataaaccatcattcctccttgagcctgattaagctctctttatgaagacattatggataaagtgtcaaaatggtgcctggtttggagtagcttctcaatagccattacttttctgcaagcctgatgaagcatctcacatcacaagagactttcagatgtctgtgtattgtggtggaaaaccaactcccattcctttgcaaggccagaagcaaaagctgccatgaggaggtggtcttaacatggcctggcacatgtaagctgttaactcactaggaaggaacaagtttgcaactggtgcaggagaatgtctcagtgatgagcaagacttctgcagtgagtccacaagtatgtctttatgcctggaattcattatcaaggaattcagaaatgttttctgagaagaaatccacctcggtaccctgcatatttcagtacaccttgacctgagcagaagatacactgagacctgccaagttctgagcatgaaaagctttaattcattgtgttaaatggcaaaaccaagcaactggtgatttatggctgcaaattatcatgttgttcattagtggtaattactactcaaccctgaaataaaacggcaatcagtatgctaaaatgagaacacccacgctaactccttgctgttcacctgcaatcctctctgtctgtctcactttccaagggaagagaaaaaagactgagggaatccaggtgcatgtactatggacagagatgagcttctggccatactaaactgcttcagtggctcctgtcaggcaaaggagcttagctccatccctagatgctctctgttcacaatgagataagagatttgtgtttggacatactctgggaatgctcagattgctttcagcgactggagctgtggcagtcaggagggagaggaagccaatggaggtagtgtagtgagtagacaccacgccctcagcgactggagctgtggcagtcaggagggagaggcagccaatggaggtagtgtggtgagtagacaccacgccccagatgactgtagctcccgtggaccccattagcactgtcctccagtagtctcttcaggctatatgcctggctgaccatcaggaaactgaggccatgccttgcgtagaaagacttaatttcacttttgaacagatggccagaaaccatgcaatttcacctgctgtatctgttaatgtcacactaaacagctatgaagtaaaaactcccatgcaaacaggttttcattttatttctgtcacaattattacctcctagagatgaccttcaatgcagagaaatggatttttgactttaacataatgaatcttatgagcagttcacacaggcattctgaagaacaatacaggttgaacatccctaatctgaaaattcaaactccaaaatgctccaaaatctaagattcttgatcattgacatgatgctacaactggaaacttttacacccgacctcatgtgacaggttgcagtcaaaacacaagcacacctctcatagtttattcagtgaccccaaggggaaaaaaaaagaccctccaagtaccattcacttgtgataggtattttctgtgcacacctagatactcccacacaagtatgcccacaatggtaataaaatgacacatgtgcagaccagaagcaccagcagtaggttcctaatgatgttccacatgaggccaagacctacgttcattactcactgaagtttttggcttatgctatgctctgtgatatcaaggatgtgatgatatttgttgaaaatgtcaaaaaagcctgtagatacctctatgagtaacagtgataagaacaagaagaaggatttatgttaatttagaacacagaaagtcaagctgttggagaaactgaacagcagtgtaagtgtgaaccatcttacagaagtgtatgatggtagaatggctaccatatatgacttgaagaaacagaaggataaactgttgaaattctatgctgaaagtgataaacagaagttaatgaaaaatagaaaaacactctaaagcgaaaactgaaggtcttgattgcatattgaaagagtggatccagtagtgtcatggtaaacatatgacaatcatattctggccatgaaacaagaaaataccaattacaatgagctgaaaaattatagagaactgtgaagattcaacacgctggctgcagaaaatttttaaaagacaaatttgtaaagacttgtgataaatcatctgcttatcatgaagcagaagagaaattcattgacaagtttgccaatgtcatcactgctgaaagtctgacaccagaataagtctataatgctgatgtaacataacgattttggtgttattgccccagaaagaaactgactacagctaatgaacagctactagaggaattaagaatgccaaggacagaataactgcaccaggatgtgctaatgcagcaggcacgcttaagtgtaaacttgctgtgttaggcataagcttgagtcctcaatgttttcaaaaggctaagttcttacttgtctattattatgctagcaggaaggcatgaatcaccagagacatcttctctatctggttttacaaacatttgtaccagtggcttatgctcactgcaaagaagctgaactggatgaggactagaagatttttttattccttaacaaccgttctgttcatcctccagctgaaattctaaaaaataatgtttatgtcatgtactttcccccaaatatgacttcattaatttggccatgtgaccagggtatccttagatcaatgatgagtaaatataaaaacactttattgagcagaatgctaacagcagtgaacagtagtctgggtatggaagggtttcaaaaggagtttagcataaagaatgctgtatatgctgttgccaacacttggaacatagtaactgaagacacagttgtgcgtgcatggcacaacatctggcctatggctatgttcagtgactatgtttcaacccttcttgcacagatggactgactttaaaatattgattaatggcagcagaattaaatccctttacaaaaatcattgtcattctttaaatagggtagagggtttaccttctgaattttccatttagcatgggtcagaggtaaatatatatgtatgcacgatctttgcagtgagagaaatcaaagaatattaagatctctttatgcctgctaattttgagttgtgaatttttgagtacgtctaaagaatgggatatggttaagtggtttataagcattttttttcagtccttgattcatcttttcattatctttaagggcagatatttttaatttaaaaaaatctaaaattttaattttttcattcatgggttgtgcctttggcattatatctaaaagctcaacacgaaaccccaggtaacatagattctttctggaaagttacaagctattaatttaattcttttaataaatgtagtcctattcagattatctacttctggtttttgtagattatgtcttttaaggcattgatcaattttatataatttataaaatttgtgggcatacacttgttcataatatttattatattttaatattgatgagatcagtagcaatgatccttctttcattctttatatagtaatttttgtcttctttcatttttttcttagttaaactggcttttagaggtttaacaattctatttatcttttcaaagaatcagtttttcttttcattagttttctttattgatttcctgttttcaatttcattgatattgctctagtttttattatttctcttcttctgattactgtagatattgatcttccttttctagtttttaaggtagaaacttagattaatatttagatctttcttcttttctaatatattcattaaatattataaatttccctctaagaactgcttttgttgcattgcacaaattttgatgagttgtattttcatttttctttaattcatttttatttcaaatttcttttgcctcatctcctttgattcatgtgtttcttatttatattttaatcccataatgatctgagagaatactttgtatgatttatataattttcatgtgttaagatatgttttgtgacccagaatttggtgaatattttatgtgaaattgagaagaatgtgtattctgctatggttagattaagtcttctataaatgtcaattagatccagttggttgacagtgctattcagtcaactacatccttactgatagcctgcttgctggatagaagggttcaagtctttaactaaaatagtgaattaatctatttccccttgtagttcttctagttttagccttacatattttcatgctgggtttacaggcatcatacattttaaaaattgttatgttttctggaaagttgactcctttatcattatataatgctcctttttatccctgatatttttttcttgcactgacgtcttctgtcttctttacctgaaattaatatagtcacaccatattattttggataagtgttagcatggtatatcttactccaccatttatggcacccacgccattatatttaaagtgagtttcctaaagacaatatatactttcatcttgtttttaaaaatatacttcgacaattgcttttaattggtttaggctatttatatttatagtgatttttgagatttctggattaatacctatcatatttgtaaatgttttttagtaattgatgacctgggtttttgtttctttttctttgccttccattttgttttttcatttttggatctaattaagtattttatatgatggtattttatcttctctgttagcatatcaattatgttttctagatatattttgttagtgattccctacagtgtgctgtacatttacaactaatctatgcctactttcaaataatactgctcttgactagtatagataacttataaaaagtacttccggccgggtgcggtggctcacacctgtaatcccagcactttgggaggccgaggcaggtggatctcaaagtcaggagatcgagaccatcctggctaacacggtgaaaccccgtctctactaaaaatacaaaataattagccgggcgtggtgcaggcacctgtagtcccagctactctggaggctgaggcaggagaatggcttgaacctgggaggcagagcttgcagtgagctgggatcatgccactgcactccagcctgggtgacagagcgagactcaatatttttaaaaaaagaaaaaaagtacttccaattacttattttcatcccttataacattgctgtcattcatttcacttattcataaactataaccacccagttatctgttagttcaaataaaaataagaaaaataaacattttattttacctttatttatttttttctgtacctctctccctttccctaagtaggtctgagtttctgacatataattttccttctttctgaagaaggcttaacattttttgcaaggtatgtgtactggtgacaaatttccttaatgtttgcttatctgagaaggaatttctcctttacttttgtagattaaatttcactggctacagaattctaaattggtgatggtgggttttgtttttccattaacatttgaaatattgactgccttctcttgttttcatagtttctgtgtggaagtctgtaatacttatacttggttctctataggtgaggtgttttcccttcccaccattgcacattcccagtctcttttcaggattttgttttgattttgtgcagatttaacatgatgcataatgtagagtattttccatggttggtattctccagcttcctggatctgtggttttgccttcatcattaattttggaaggttgtcagctattattacttcaaaaccttttctatatggttttctcttgattttccttctcgtcttcctataatgtgtgttatatctttttaaaattgtctcctagtttttcaatgttctgttccactgtgtgtttattatttttctctttgcttttcagtttttagtgttgctattgatacatctttaagcatactgagtccttccttgagaatgttaaatccactgatgatcatcaaaggcattttttacttccatttcagttttttttttctagtacttcctttggattatttcttagaatttttatctctctgcctacattacccatctgttattgcatgttgtgtactttttcattagatcctttggcctaacaatcagttaaattcattttctgatcatttaaaaatctctgctgtatctgagtttgattttgattctccctttgtctcttcagatttaatttttttttctttttctttttagcataccttgtagttttcttgtgaaaagctagacatgacatattaggtaaaagggattgacataagtaagcctttagtgtgagtttttaagtaagtttttttcctgtagctagcagtcagtttttgtttaatgttaactgtagttacaggtgtcagaggctaaaatttccttctgatgcccttgtttttgtcttccctgttgtccttggacttccctagagacttctttctaaataaattctgaaacatgtggttttttgtttctattctcctgttattgtgtaggatccctgtttatgtgtggtaaggtgtgcaggaaagaaagtgttttattattctatgatgagagctcaatcctctagtgggcttgagccccagaggtgggtccttcacaagtgatttttagctttttttttttttccccacacccctccccttacatgagacaagctagagaggtttcaaattaggtatttccctccaatgttgaatgttagaggaagctgtaattgggtatttctcatggtggttaggttctggtacaatagttttctctggggaaaggcctttgttaaggagaacagaacattctgagtatattttaaatgaaaactttttcttttcccctgccagatgcattaggggattttcctcatcttcaccatgataacctctagaggtttatggaaggaaaacttatgaaatcatggggatccttctaaggctggtcctgcagaagtttttatatttcaagcttgtccacacccagtgtccaactgttagtcaagtgatgttgaagtgttttaacttgtttctgactccagcaatggcttctgctccctgtaatctataactgtatttatctttctctgcagtttttaaggtagcagtttgccctgtgacttccattttccaaaggctctaagaagacttgttcattttgtttcactttgttctttttgggaggataacagcaataactgctgagctctttacatgccaaaaaagaaactaggaggtctatgacctgtttttgataatcacatatgactttgtagaaatcaggaacaagctctttgacaataattaaggaaatgtcagtcagataatttcatatttgaaatacagtaaattttttaaaaacaaaatgtgtatctttttaaaataaacaatattcctggcacacagtgatgctatatttgcatattcccttaagaatttaaatattgtgtaatttttctatttgctgtggcaataatacaattgagtgaattcttttgcacttcaaagtaaaaaaaaaattagacacaaaatgttcctagtgagattttggctaatctgatagacccatatgtaaatgtgctgtacaaaagtctgaatattttaaaactgttaatgcatgaagtccattttaggttggttccacaacctaaatgatactcactaaacctaaaaaattcagatgataatttttattataaacattggggaatatatacatgcattttcagtttctctcatatttcaatttctgtgatcttataaattcaacaaacgtttatttttctgaaataaagacatttatactcaataaaatactgtaatattacagatctcctgaataaggctctttctagtgctagatctcagtagccttttttatttgttcagagaatggaggaaggcaaaaaaatccaaaaaatatatcatgttctatttgtataaggctttacattggataaaagaacactattgatatctgaatagaactgttatgacttatttgttgttcttgtcattgttttacttctttaaggttggggcaatgcctgagcacactggtttacacctgtgatttcagcactttgggaggccaagttaggaggattgcttgagcccagaagttcaagaccagcctggacaacacagcaaggccccatctctacaaaaataaaataaattagcttggcatgatgtcacatgcctatggtaccagctactgaaaaggctgaggtgggagtaatgcttgagcctgggaggtcaaggttgtagtgagccatactttcattactgtacttcagcccgggtgacagagcaagaccttgtctcaaaaagtaaaaaaggtgggggaacaaaaataaaaatttctgtacagcaatgtagcaaagttccagtataccttatataatgttagtcacctttgtgtgagattctcctctattcagagatgtgagtaaatagatgcatattaagtacaattgtacagtataaagatcccagcaattacattttttttttttttgagacagagccttgcttggtcgctcaggctggagtgcagtggtgcaatctcagctccgcctcccaggttcaagcgattctcctgcttcagcctccccagtacctaggtctataggcgcgtgccaccacgcccagctaatttttgtatttttagtagagatggagtttcaccatgttggccaggctggtcacaaactcctgacctcaagtgacccacctgcctcagcctcccaaagtgctgggattacaggcgtaagccacttcacccagccaacattttaaaaaatgccctctaaatcataaaaatgtccaacactaatttaaatttttccccttgaatcagtcagaatttctcctgtatagggatgcattctgaccgtagcacacattgggaaagtttccatttctacacagtggtggtgcttatacgctcctcagggaatgtaatcatactgctgaattaattgagctttaaaagactttgtcagtaaggaatttgataagggggaagaaaattaaacagggtcctaatattggcccactggaggagaactgaaataattaccgtgcagtttccaattccataatatcatgccagagtggctgaacaagctcacagaactatcattccctagctcaggttatggtcttagtaaatctcctgagtgtaacgtcttgaccaaaacagacaccagtggctatgaaaaagccttcacaatgaagtcacagggataaaataaaagcgacagtccaagttgaaatgccacacaagtcgggctttcatttaaggacaatgctttcctgcccctgtgcagagcctggtgtgcattagagatggatggctgatttcctagttaacctgtagcaggtggcacaactgtataactgggccctctagccataatcattttatttttctggtgcctgtcctttcccatttccccatccctaactcctctgatagttcagtaacttcatcttccttgttggtgcttggagtcatgactggaccatatttctggtgtattttatagcatcttgaatatcctggaataaagtttctaaataatgctaataatgaagtctcttgctgcctagaagtcttggagctaggagcttggctgcaaaactcaaagtaaaattcagaaaatggtgttgtcttggactgaatttaacagaaacaattcctgcttatgactgtagactagactgttaactgggccttgacatgggattggcttagcccctttatattggattaaaattgtatttttatatatacacacacccctgtgtgtatgtgggattgtgtgtgtgtgtgtgtgtgtatatatatatatatatatatatgtatgtatgtatctctctctatatatatacatacatattcttacatgtatgtatattttttcctgggatttgtcttaaaacattctagcaaagcaagaaactgaaagttgacattttccccctgaaatatgctctaatcaccagtgacagatttaaaaataaatggctgagctatttaacttggcaagattacacactcaagagcaggtttcataaatatttaacttatcatttccatattttatacatggcaagcattcacagaggcagtgagatctgtgtggagagagaaaagactgcattcagatagacctgagtttgaatccccattcaataccatcctcactagaagactgtcagcaggtattttcatctttctcagccttgttttctggtaaaatgggcaacaaattcacaaaccacaaggttattttgaaggttaaataaaatatcaaacaaataccattgatgacaagtacctgacacatgagagttgcttgggaaagtaagttatcttctcttttaccaatattcaagatactgtggagttgcttggcactggcagtatgagtacattctgccaacttacgtggcaagttgattaatggatatgaccattataacctggtcttagagagggttcagctaaccgttaaagatgcccagtttcactgtgcctgaagcctcccctcccactttcttggccctaaggaaaagtcctgatatccatcggttatttattttcaactcctgggattccttcccatgattacagtagtttgatctctcaatgtgacaagaaaagctgaattattgaagaaaaatctcccagtccttcaagtgtaatttttttagattaaaaggagcaaccgcatttagaatgcttatgctaaaatgtattcattgtttagttggaattcaaatgaactgggtgtcctgtaatttgtctagtaatcctacctgttctaggtttctgaaatcactgctttaaggcaggcccaatgcctttaaaccaatcactgggccccagtaagccttttatctggtaggtaagctgaataggggtggagtgtgtgtgtgtgtgtgtgtgtgtgtgtgtgtgtgtgtatgtgtgtgtgttcctattacaagtaataaatgaaaaagtcatctccattttctcaaagcagcatcaactttagaatgagaaagttgcataattgagatgagaacctaccactgtctttctgacctaggttatatacatttagcattgtacatacgtgtgcacccttctgcagtatacatctagactggcaattgacggagatatgctccaagagagcaaagcagtttctccttaagcctacttctagtctggcctgctaactacctattaatgtttttctgaaatttaaaattaaatgacactagagtgaaataagcaaccagcgattatagggaataaaaggtactctgaacacatgggagtgatgatagagtctatgcatcccaggcacaaccactgatcttccactatgcatgaataaaccttttaagactctcagctactttaaaatattttgcctttcccaaccttaaaatattttttcagatgatccctaggaaaaaacagtgtctggaaccacaagccattatgaaatccttattaagtacacatgtaggaaaggaaagtcatcaatgcatttcttggctaacacaaatgtagatcagaaagacttggagtaaaatctctgcaactttacacaaagtgaagaataccataatttgtatcaatatccatgctattcacgtgactgccctttcaccacttgagaatcgtgtaaaaatttgctcagctggaaaagaacatgacttctgaagaattttagagatgaccaaatgaaaacaaaaatttctcaaattactgtcttatgatagtgagaatgaaaaaaaaaagcacagataggaactagagccaaagatggattagaacagaaaaataaaagatgtttgaaaatgaaaatagaaaaatttccagtttctgattcaacatgtaagaagatcagaagttgtcattcccatacttatgacatgtaaaagttggacaaactaaaactcagggacttttcttggactcaccagacacctgagtttgtgaaaatgaattctgaaaaactagaggctgaaggaactgtacgtaagtactgtactctagttgataaagtactgtactctagttgataaagtacttattttccatggagatatgggttaacagttctgaaatcatatcatatatagtataattgaatgttttaagaaactgatggtagttggtggaagccagatttgttgaagtgagagtttagagatgagtaaggggaggagactagaatgatccatgtggtaattaatggagtagagttggatacaacagcatgaactcctatttagatcgacatatatatcaatgtttacatatggaaacatttatagatatgcatatatacatggaatagcatattcacatgcagatctttgccctgtcagttgagagagcctagaagcaacgacaccccagtatctatgagcacacctgtaactcagatcttggtttctaaaactattttccaatttttactggagccagggtcccttgaaaaaataagtggcttattctaggactacagcagggaatatacaagatgagctggagcagcttgccaggaaatataaaaaatgctaaaaaaatgacaatgatatgggcatgtcataatattcagaagccaactggaagagttcccaattttcaaagctggaacaatttgagcaacaaaataaagttagattggactgtaacccagtgtattaaatggaaatccatgtgcatatgttggtataaaaaatgattccataagtaaataaacgggaaaaatagacaaatctctcatgcagaaaaatttcaaataatttattttgctactccatctacataaataattgagatgaaacgtaacttcttactccttaaatgtaggctacacatagtgacttttcttccagagagcagtgtatggaaacagaaaaaaaaaaagtaacattacaattgagaaacctgacaagcacatgtcaagtaaggtgatcaaggttaatatcaacagtgataagtcatattgatatgctattataatagcactctatttctctggttttctctcagaaataaattaccctagtctagtcatgagaaaatcatcagccaagtcccgattgaggaacattctacaaaatacccaaccagtaattctcaaaagtgtcaaggtgattaaaaacaagaaatgtctgacaaactgtcataaacaaggagagcctgaggaaactattaaatgtgatgtggcattccagatgagggatttgaatagaaaaacagcattgtttaaaaactgaggaaatctgaatgaagtatagactttagttaatattgcttcagtgttgattcattcattgtgacgaacgtactgtactaatgtaagatgttgataggtgaaacttggtatggaatataagtgaaatttctctactatcttcacaataattctgtgagcctaaaactattctaaaataaaatatttaaacactacaaatagaataaagagaaaacatgtaaaccattatttatttcatcagtttacttgttttgaaaataattctgtgcttcttctatttcctgaattttataagaaataaatatgtgagaaaattcaacaaccagtactcaaccaagtcaggtgtgaagatactcacttttcatcttctttgcatcccaacataattatttcagctttagagaatgtggttttgttgaggcaaaagtatattttgaatgctgatgatgtaggtttgtgtggaattcctattaaggaatgatcaaatgatctggaaagtagcaactgtttttgagattcttatttaaagatttaaataatttcatggacattaaagtattttgtaaactatatagatttcagtataaatataaatcattgttatcgtgtatgaactcattaatttattttttcattaaaagataagcttttatacattgtcttctccacccccaccacccgccacctctctatatatatagagactggggggaagagaaccggaagaggatgtataatattctatatatatatatgtacatattttttaaccaagccctatgcactgaacagaactacaatttcagttttgaaactgtctttctgaactattttactcctcatcgggcagccccgtggaggttttactgtttaagttttacttcctatttctcctgagagtatagaatggcattgaaatggcagagccattcaaaccatctgaattgatccaatatttcaattcttccaacttttttggtgccttttaggataaggctatttctttacctatgtctgtctttcaggagcaggttcttgcatcagatcaattttgtgaactggtttgtttcacctgtgaatgagttacaggtcctgtatatcatggtccttctaggacccaccctcatcttgataaacagacgctggaggtttagatgcacctgtggatgatagaggacactcaactttgcaaatggaatgtgttgtctggaggatgccatcatagaaacatgtggttccacttagtatttagtgttttgaacagatattgaggagcaggagaccctgaaaggtctccatagtgagagtgtgccaaccagagggcatgttacttcttttttacattcagttgtctcactagcacctcaaactcaacatagccaagttgaaattatcatcctccttccatattgtcccatccccctattcctgatgaatgacatcaccatccatccattgaccaaattgcaatcgtatgagtcatctttgacacctcctcctctctctcatctgacttgcaatccccaaatccagttgattccaatgttcctaaacatctctcagagtattcaatgccatttgactcggcagggaaatgtgataaacaataaagctactgtaacagcttactaatattgaccaaaggtcatccccttccaatccattctccacagaacaaagccattctaaaatacaaagatgatcatgccacttcctgcaatctcccagccatgcccattgtatgactcctatgctgaatgactttaagtttctttaatattacatgctctctttcccactgtgggttctacagatgctgtttgctgtgtctgaaacatcctactgttcctctctccacttaccaactaagctttcatctttcatcctccacctaatctctactctcctttcaggatcatcagaggtattacctcttacaaatatctttccctgccttccaaatcctgtctccaaagcctggattatgtacttattataggttcccacattgcactcagtacattgtctccaccctctactagcttggaaaaatctgcgagagcaagaagtatgtctgttcatgttagagttacctctaatgcctgacttgatacctgacaacatagtgttgctcaatcaataattgtaaatacctgaattattaatgcatgaataaataaatgatttggtaaatatacaaatgtatgtattaaaaacaggagagaaagaaatggaaatatttgtataaccagaacatcaggcaattagcattaggaaagctttttttttcttgtttaagtaggttaaaacaggccttaaaagacaaaaaatcgtggaacattaagatctctctcctttcccccctcctccttctacctgtgtgtgtgtgtgcacgcatatgtgcacttgttaaaggtagagagagggccgggcacagaggtcaggtgggcgggttgcttgaggttaggagttcaagaccagcctggccaacatggtgaaaccccatctctactaaaaaatacaaaaattagctgggcatggtggcaggcacctgtcatcccagctactcaggaggctgagacacgagaattgcttgaagccaggaggcagtgagccgagatcatgccagtgtactccagcctgggcaacatagcgagactgtctcaaaaaaaaaaaaaaaaaaaaaaaggtagaaagagatggtgagagaaaattgttggcaagattccagtttctttccactagaaggcagaaagcactaaacaaatgtcaaggcagggacctaggtttccagaacccaaaaggagcattgggagtttgtcactgagacctcagaggcagagcccaagaccagaaccgaactattactatgcggacttgatgttcaatgaatcaatcgcctaagtatccctaaatgctccactaccctgtgcctctctacaaaccccattataattcattcccaagccatgatcagaattggctcatcagtttgtgcggtggtaatgaggaaggggtaggaagttgggattcagtgggtctaccataaggcagaagaggaagcaaatcagacacattccaatgatattatctgtttggttttgcccatatctgattttcgaagtcttctatgtactgaaatcaaatatctcacattaaaaaaaaaaaaaagcttttaaagattgtaggttgacacagcatagaatatcccttccttcttctagaccagtagcattcaaagctacctggtagtgtaattaagattttacatatttcaagcttcttcactgtaactcacagcagcttggaaggtaggagtaagcttcatgacaatgatcctctgcattttgatgggtacaagctgttctttgatatcatggacaccccagcttttcaaaagaagattcttggctgtttagcagttcagccaatccatgtaattgctttttccatgttacataagagtaaaagtctcctataattatagggataaaagagacttgatactttccagatcaccagagcaggaagaaagaagaaaagcatgactttttggagtgattactcatcacatgccagacacaatgctgaaaactttgtatccatcatatttttatgccacgaaaaccctgtacagaagacataagcacccccattttacagatgagggccctgagactaggggaagacaaagaattcctcaaagttagtttacttagtacaaattagaattggtctttaaactgactccaaggaggatggccttttttactctaccacatcccctctccaacactattggtttgattttctgttacagaagtacaggaagacagtgtttcttttctagctatgcaacaatgacatgtggtggttgaaagcatggcctctggagccagactgcctgtgaccatttactttttcttgaacttgaacttatactttagtttctctgtgccctaatcttctcaagtgcaactggggttaataatggtcccagcactgttgaaaggactaaatgactttgcacctataaagagctttgtattttaagtgctccataaatattcatgttgtagttgtcattgctattgttgttgtctgtgaggccttttcacagaggcatggcctcgcagaatagggacaagcatgctttaatgctactcctgtcttcttaattcccagtagcagaaaaactggaagactcctttgccaagggttattattttttaatcaatctacgtagggtttatacatagatgatgacagagagaggtaggtacagttatttatagcctgtgagtcattatgaaaagtcactctttctttgcttggtcagagcagtgagaatacatatatctgcaactccatgtgtgtagaactagcagcttaaactggaaagatgacctattgccttagtctttcccagagagaggcttgccctacacccccttttgcagcctgcccaggctaatgcaactagcgatggcaaggcaagcagggcaggctgccatgcattttaggggatttgagcagtcaggcagatcattcagggagagattgttttaaaggtttagctaaaagccatttatccacctcatttcaagcacagtattggctccaaagtacagttggtcctccatatccatgggttctgcatccatggattcaaccaactatggatagaaaatatttggaaaagaaaactccaccaagttccaaaaaacgaaacttgaatttgccatatgccaaatatatcaaatccacgctaatgaagtgatgtgtaggcattgtattaggtattataagtaattcaggaatgattgaaagtatataggaggatatgtgtaggctataggcaaataacacaccttgttgtataagagactttagtagccttcaagtttggtatctacaggggatcctggaatcaatccccaagcatatccagggacaactgtgctatattgtgatgaagttccaccacttagctttatagctgaggactacaagctccaattatcttagggaatattctggtgaccaaataaataaaaactttctaaaaagtgatagtcacttgagcatccaagaagtatctatcacatccttaagtcattccattttcctttatatctctctgggtgagccatcttgtcctgaatacaatttgtaatgccgggtaattacttcctgacagaaatttcttcccatttcattctctgtgtgttaagctcatttgattacaacaaacaaaacaaaattcagggacattgattaatgcaataagagcaaaataagtaattaaaattaacaagtttctaactttgaggcctggcctctctcacagagtctgtggcaatattaaagtgtgattctagcagaataaaaacagttcttgtctcctgaaatgtgaataatcctcagtagatctgcctttggattggacatccattgaacatgtctcaactgcactgtgtctctttgtctttattttctttatctttgggtcattcccccaattctaactgacctttgttatccttctggtctccagtttagttttctgggaagggctctccctggctcagttcctcagcaccatcactacttgagcagagcttttccacctgaagtgctcaaaggactgcccatctgtccttgctcagggacccccaacacggactgcaaggctttagaagttgaatccccagcacagagctctaatcataggtgccgcagaggccttgtctccttgctggtgctgaagggtggtggcttccatagcctgacagtctctttatttacccagcacaataaaggaactaacattattcttgtggcaattcaaaaaaatacttaaaaattagtttgagacattatttaaatttttattatacatcccctgacaaaataatttttatttatggaatgtatttttttattttactttaagttctgggatacatgtgtagaacatgcaggtttgttacataggtatacacgggctatggtggtttgctgcacctatcaacctgtcatcattatttctcctaatgctatccctcccctggcccccaccccctgacaggccctggtgtgtgatgttccccttcctgtgtccatgtgttctcattgttcaactcccacttatgagtgagagcatgtgctgtttggttttctgttcctgtattagtttgctgagaatgatggtttccagcttcatccatgtccctgcaaaggacatgaactcatcctttcatatggctgcatagtattccacagtgtatatgtgccacattttctttatgcagtctatcattgatgagcatttgggtttgttccaagtctttgctattgtgaacagtgctgcaataaacatacgtgtgcgtgtgtctttatagtagagtgatttataatcctttggctatatacccagtactgggatggttgggtcaaatggtatttctgtttctagatccttgaggaatcaccacactgtcatccacaatggttgaactaatttatactcccaccaacagtgtaaaagcattcctgtgtctccatatcctctccagcatctgttgtttcctaactttttaatgattgccattctaactggtatgagattgtatctcattgcagttttgatttgcatttctctaatgaccagtgatgatgagctttttttcatatgtttgctggctatataaatgtcttctgttgaggagtgtctgttcatatcctttgcctactttttgatgggtttttttttcttgtaaatttgtttaagttatttgtagattctgcatattagtgctttgtcagatggatagattgcaaaaattttttcccattctataggttgcctgttcactctgatgatagtttattttgctgtgcagaagctctttagtttagttagatcccatttgtcaattttggcttttgctgccattgcttttggtgttttagtcatgaagtctttgcccatgcctatgtcctggatggtattgcctaggttttcttctagggtttttatagttttaggtcttaagtttaagtctttaatccatcttgagttaatttttgtataaggtgtaatgaaggggtccagtttcagtttttctgcatatggctagccagttctcccaacaccatttatttttatctatttcagggatcagcaggtttttttttttttaaaagtaaatctcaaacttgttcaaagagtaaatatctaggctttgttgacttttactcaagtctgctattgtagtacaaaagcaaccatagacaatacaaacaaatagatgtggctgtactccaataaaactttatttacaaaagcagctgtgtttggcccctgggctgtaatctgtggagcctgatctttcccagtgcatgtgtacccatgctgtgctcacaccccctcacactccatacccattttgtacatctgtgttcctttgttgcctatattgcatagctcactaatctgagaaggctggatttcaccgaattgcatgggagtcccactgttgtcaagacactcatggtctgttaagtggaggaaaaacatgaactatctataggagaaccaatgtctcagaatcatcaacaaatgcatgcatttgggagaaatttctagtattctaaaatggatcgttttatcctagaaatggtgagaatggcactctcatcacacaaagcacacatatctgcttaggtacagacatttgctgaatccgaattataatgtcctcttctgccaaccctgtaagatgctcacatgctaatggtaggggtggaggaatggtatgaaacatgaaatatcttctgctttgacaactgtcttaactctgttgttctctcctaaaatgaagttgtgctttgagccactctatctaaaactaggctgtcatttctatgtcctaagggatgcaagtaccgttttacctttcagaaagcaaattttaaaacaatccccaggtataagatttatctttccgagcagaggatctgcaaacagtgcctgcggacgtgtttactggttaaattttattccaactatgagctactaagtcttccagcaattgttctttcttaacaagtttgtcttccttggtgactgatggtttctacttgttcacttgatcagtgtagcatttgattccaacagaaatgtgcagtggctcacccctgtaatcccagcactttgggaggccgaggcaagaggatcacttgaggtcaggagttcaataccagccaatgtggtgaaaccccatgtctactaaaaatacaaaaattagccaggcatggtggttggcacctgtaatcacagctatggtggctgaggcaggagaattgcttgaaggtgggaggcagaggttgcagtgagccgagattgtgccactgcactccagcctgggagacagaccgagactccatctcaaaaaaaaaaaaaaaggaaaaagaaaaaaaatgaatctttataatatacaacacaaagagggattttgatgggcttttagttctcgcagacccccctgctgggttgcctaaacttgtagtggcaatagagcatccagaatatctgcccatttcttccttaggtacatgagcttccctgtggctttagatcgttcataattgttgggttcatccaggagtgtcactttgtgaactttttctcaaggtaataacatgtgtgagtagcacgaggcattaaaagaaagaagagagatgggagtgtcctttagatgtcctcagtactgttgttagaacctgcacaccagttttttattcacagtttccccttgtgtggcaatttatttgcagtgtagctggtaatatttgtgacatagaatatgttatgctatgacgtacctactatggttagcatagtggtggaatttaagaagggatatttaattaatagaatttataaacaggactatctgtcttcagagacacttcagggataacgataaacttcagagatactgagaattgcaaggggatctcagtctaatgacttttgagtgccttttcggatgtgaacaaacccagcaatagggtggataatatgccttaactgggtccccaagatacttgattgtgtatattgtctggatgttcaggaacacatggtcttaatttcttagatgtctctattgtgtgtgccagtttagagttcagtctgggtgcatttatgttatatagttttttccatattttcttttagggtataggaacaaaacagtcagcaaaactgccaaggtgcttgcagatcaaagtgaagataaaaaatgagtggagtgattgcaacacaaggtgacacttgatccaatggaggttactttcactggctttcctagaagctcatactgggaaccccatctatgggactcgtggtgggtggtgggggatgacagaaaacttcctcttcatgaaaatcttaggtctaaatgacatgcttatagtttggtggatggattgagagaagcagggaggcctttccaggcagaaggaacaaaatgtactgtcatttggaagtgacagcaggatgcactgacaggagcctggagcagagtataggaggcgatggcaaaaagaaagactcacaggttaagacaggcccagggcatgaaggacaagcagccactgcacacatcccctccactaactgctttgttctgctccctcttgcagtaccaatactatccaatttttgtctatactagaaatttgggagccatgcccgatccaatttccttcatatcacccatttactccatcagcaggaatagaaagcttaccaactttatttacatattcatccatcctttattgataaaataaatttatttttgagatactttccatctgacttcaaggttaaataaatgttaatgaaggaggtaatgaagcaagacatgcttgaactttggagccagacacaatttgggttggaatcttgcctctacctttcaccttctgagtatataaccttgggaagctgtcttgggatcttcagacctcagaaaagagcacaaagaagttaattatatgttcctcagagtacctgccacagaattattaaatattcaatagtggaaattcctatatcctcacttctccttctagttttcatttctctcctgaaacttcgttcattgcattttgaaaccttcattgactcttctattggattttgaggtccttgagggccaaggttattgttagggcttttttgttttgctttgttgttgttttttaataaaacactttctgtgtttatgtttctagttttgctcagttttggtttgcacgggagtctcctgcagtctgccgtctgagtgcaagagggaggatgaatgatatccctttcagcttcctcaggtgtggggaaaagattaggaaaagagcaaacatttatggcaatctggagttacagcatgtgtttgagtcccaggtattttcctcatacatcgtttagcctctttgagcttttgtttcttcatttgtgaaatgaagataaaattcttctaccttatctggcctataggatcatccctggatatttgccttgaacagtttacagtcttagctcccacctgcccatgggaaggaccacagggatcttgtgcagcatccccaaatcttctgcagcagcactccaagttccatctccttctctccattccttcacctgctttccgacaggtttcattctgtggccagtactttgttttcctctctatggcggctgtttgaaatttaggattccgtaggacagccttcttactttgcaattctgacctcaccgctacacaccatagttcacattaccctcaccttcattaatgtctctaacagcaacaatacaaattgagtaaattcaatttagggtgattgagatgtcacctgtttttattctttccataaattcaagcaagatatgttaacaattgttcggatgtcataatgttatgctagaagttattgggctctttaattgaatgttctcttaatttgggcattggtaaggtaccaatttgagtatgcagacttgatagctgggtttgccaccaccctgagctagtagtgtatgtggatggcataaagaacatgttggatctttccacctctgactggggctctctgtggccagcatccaactcagcaggatcagatgattccggaaacactgactgcttctctcctgcaagctcacagtggagcgtctggcactccctgagatccctgccctgcatggctttttacacaaactgaacaaatcacattctctaaatgagagaagtgcagctctgttacatttcaatcttctaaagaggaggaaggtcactcgtcagagaccttgtggtcatcagcaaatagggtgatccaggatgaagacacacaggcagtaaatgacggtttcttcctcctctcccttctcctcctttccccttgatatccagtcttatcttctcccttcctttctaactctccttttccaatctgttcttcactcgcctttcttctcttctcttctttcccttcttctctccctctttattcttcttccagaaatctttaaatgagtcatgattcaagtgaaaaaagattcttagctaactcacatatggaagcagcaaattttctcagattttgagctccttgaaagctgagcagcataggagccttcacaaccctgtagtccaggcagcagtagaggcatttctctccagttcctgggaatctcatccgacagtcaacttgtgttgacagagtgagtaggactgtggcttttatttatttatttatttatttatttgcatctggatcttgggaagtaagcatgtggcataagctgggtttcttacattgccctaagtcattgtcacaagtagaaagaagtatggttgtacctctgctgcacaaccactcaggcaactgttcctaatgtcttctctgaggccttctttgtcacttcccaagtctcaggtatgggcaaattatcctctatcctaccccattatatttgaattccaatttgctcgtagttcattaacacctaccacactatttcctatttattttgtgtccattcgccagctagattgcagaagttgtgtaattgtgcctcattcgtctttatagccaaagtataatcctagaacagtttctaatgtcagatgcatcagggaacccaataaatgtagatggtaacgttatgctaatcttacattttaattctattagtggtgaaatctttatgacttagtcctgtgagttgcattgaaagattgatctaagcacctcttttgtgttggaaaggagatatattttcaaaatttttaaatattaatacatttttagcatggcatatgatcgttttgaaatacttatttcaatatcccatgttctaaaatagagtgtattaacagaaattttgagatgtggtaaggccaactgatcatgaaatgattgccattgaaaagataatggtcttgagtatggaatcccaaaaaaggaggtaaatgggggtctgggctctggattgggttggtttttatttgaaaagtgtgtgctcgggcaatttattttctatctctaggaactggttagtcctgagaggggaaattccttcagggtcaggaagaaccagatatcaaagaatcagaaatacaaaataaaagatagacttaatgcagcttatgatgccaaaagagattcacttttctctaaacatgaatgggcatgtagaaaaaacagcaatctctacagctgtctgggtacaattgctgtcacaagaactattgccataatgcggttaggacataaagtaaacttaaatactctacatactttttataattggaggttgtctacatagacacagtagagacttgagaagtccccagagaccttaaaattctattcagttcagctgtaaccgtatcctccaatcaccttgtgggtcatgtatggattgtcttgcttctgcatttatcttccagagatttgctgcttttactaattattggagtagcagacacctctattgcttctgcctctcttgaactatgattgttcttatctctgggtactaagtccatcatccttagatcctgtagagcactggctgctgaggcacacttatcaccaaacgcctgttggtgtcactacagagtaggaaccaaattgctctcactgctggatgacaacttgtttctcatctagcatcctaacttatctggtaaggaaatggataactgcagtatataattattgtgtatcagtaattaactcctcctgccctctgtttaggtaaaagagatgaggcttaaaaggcgcacaatttttaaatgtcaaaagtatcacttgactcaaatctttctgaacttagcacttacaaacttttcagtggaccacaatgtccaacattaaatgctggaaatcaccataccgtgggtttgtaaaacaggccaatattttttttatggatacttttaaggtccatcctagaggcctatttatataaacacttcatgccttactctgggaacttatcactaagattttcttcaaagacctggtgaatcaggattttccattcatatctgtgaattaaggatacctgggggtaatctctgtcactgaatacatcaatatatttgccagttagacctcttctttgctggagaatgctgacttgcactttttgtataggtaaggtttatcaacaagatttgtacaaggtcaagattgggagagctgttagtctgagaaatgccaaatatcagaatggggaagaacgagatcgtctctagaactcctagttactcagaggcattttatttcatttctttcatatgatttcttctttctttctttgttgtcttttccacacaccttacagatgatcagtattctatttaaaatgtacttaccacaagtacacaaggctctttatctcaacagtgattatagttaggcaatagtagaaataaaataaatgtccatatgactttaccatatgacagaatattctgcagccacttaaaaggatgagatagacctatgagcactaacataaacaacgcccatgacttattacaagttttagaaaacaggtaatctattatttataatagcaaaaaatgataacagtaattctatgttattatttttctctttttttttaaacggagtctcgctctgtcacccaggctggagtgcagagtgcagtggcgcgatctcagctaactgaaacctctgcctcctgggttcaagcgattctcctgtctcaacctcccatgtagctgggactacaggtgcgtgccaccacgcctggataatttttttttatttttaatagaaacaatgataaatgagccatagctacctgcaacaacatattgaatcttataacataatactgagcaaaaaaaaaaaatctagacatataaagaacatatggtatgattctatttacataaagatcaaaaatagatacaactagcttttggtattagatgtcagtttaatagttacatgggtagagaaggtggctagtaattaggaagcagtgtatacaggggtatggatcatattccatttcttggtctgagcattgagtacctatgtgtgttcattttgtaaaattttctcacagtgtaaatttatgaattatgcatttttgttatgtattaacctttaaagtttattgtaaagggcaggaatttgaattttgaaaaaataaaagattgtgatgtttcacaacatggacagtaatgaaaggatattcttaggtgaagtaagagatgtggttcagcaagaccatgtgcaagtcagattccaggggaactagaaaccatgagcatgggtgaaactgaagacattattaagtaaaataagccaggcaaagcaagacaaataccacatgatatatggaatctaaaaaaagctgttctcatggaaattgagaatagaatgatggttatgagaggccatagggtttagggggaagatggggtcggggagatgttggtcaaataatacatatctgcagttggatagaaggaataagttcaagagacctattgtgcagcagggcagctatagtcaatgatgatattttgtattgttgaaaaatgcccatagagtgtatattcagtcttttccccacaaaaatgataaccatgtgaggtaatgtgtttgttaatcagctcgatttaaccattccacaatgtatatatacttcaaaacattgtacacaataaacacatataatttcatatgtcaatttaaaaataagtaaatatatttaaaaaaattaaaaagacactatgagcaagtagaggaagacaactgttaaacataggagtaggttacaaagcaggcagtggaggggcagggataacaaaatctccaagaagaggggtgagccatgctattggatttccatctgtagtttacatatatccttaagataaatctttgaaaaatcaagttaaaatgaattaagttgaatattatcagcactgatatttataaaagagattatatatttattattgctgtgactatcattattatgattcgtggagcatcagtatgactctgtacctgaaactaatgagtttgactacaacactcttttaattcttcatttttcttatgcacttgaggaattggaaattgttttcaaatagtttacatgttacctctcaaattcagtttttacaatgggttctatgatatattaaaataatggtaataatatagtagaaaccaattatattttattaacactggaagtgagccagacactgtgctcagtaaatgcatggtacaaagcatctcatttaatcttccagtgacccagtaggcagatattatgatcatcaccacatttcacatcaaaaactgagtcatagacaggttaaataaaattgccgaaagtcaggtaaatagagcgagaccctgggaacagatctgtgctttccgactatcagtctgcactattcaacgtggtagccacaaacatgtgatggtcattaaaagaaaaactggagaaaagttaaatttaacagactttaatagagcaatttgtgaaggggtagccctctgcaccaaattacattcagagtgactttggcactgccggaaggtgtaagagaatttacggaagcagggaatttatgggagaagggaaagtggcctacagaaaacagaagtgaggtacagaaacagctggttatagtaactcggcattcatttgaacacagtttgaacagttgactgactgtgattagctgaaactcagtgattggtacaggagtaggttacagtctatttgggcatattgttaggttaaaattcactatgtacagagaaaccattagaccaaacttagaatctgtaaggaggcagttttagggtaaaatcagcacagttgaacacttgaaacatggctagcctgaaatgagctgtaagtctcatatacggtaagtctcatataaaaagccccactggatttcaaagacttagcgccaaaacaatataaaatatttcattaatattttatagctattctgtattgaagtgatactattttatatatgttgggtcaaataaaatgtataattaaagcgaatttctcccttgattgactgattgattgattggattgcttctacggtgcctactagaaagctttggaagctgaaattatacatgtggcttgcattatatttctgttggatcatgctggtccagactggatgctctacttctagacctgaggttttcaacttcagcgctttaggtagatttgaacgtacacagatctagcttcctagtgctggaaattcagatctgctctgggctggggttcagttgttggtgtatttgagaagctcccgaggtgtttctaatgtatagccagaggagagaacccctgcctggagtccatatgcctgctctatgcagtctgatatccacctgactcgagacagctcctgatgggatagttacaacttaagcctgggaagtcaaatagccacagggctctcagcctgcgcacctatgcaaagagctgactttgctgattatgtttgtagatcttccaggatcactgccaatacctgtggtaaaggagttagattcctttagcttacacctcatctgtctgagagaagtgaagccccattacaccaatatggagaaggttgtgtgttaccttggtcctgaatgttctgtgaagcaaagttaaacggtctttagtgggttagaatccctactccatctaaataggtcacagctagaagattcccttaaaccgctgggtcagattctccctgttgtcaagaaaatgaaatgttattgttccaagtcacatgtcttgctcctagaatgtgactttgccaatgaacagtgaatcctaagtgataaaacctagaattgagggtaaggagtgggggacagctattataggttcaggaaaaatggagttaacagatcttttaaaagtgaactcggacaccacagactgggattatcttagcattgaaaactcactggtagatataacttgatgcaggttgctttttacttataatttatttgtggaagaaatagcacttggaaagccagtgcatattagacatattaatgagaagacccagggcttttcattttcttttcaaaatatgtcttataacattcacttatctatagtcagccagagatgcactgtttgtgaaaggaggggaggagataagcggttattacaggaaaggtttatatttggtgggggtgcaggggaagaaaggaaaatgacaggctgagaatacagatgtttatgaatttaaactgttatttacccttaaatatcaactttaactgataatgcacatctaaaagcattttgcgtagaaataagataaactatagagtatcaacattattataaagtaattatttcagtttttcctttgttgttgttgttgtttgttgttgttgttattggttttttgttgttgttgttgttgtttgagacggagcctccctctgtcacccaggctggagtgcagtggtgcaatctgctcactgcaagctccgcctcccgggttcacgcctttctcctgcctcagccttccgagtagctgggactacaggcgcccaccaccacgccctgctaatttttcgtatttttagtagagatggggtttcatcgtgttagccaggatggtctccatctcctgacctcgtgatccacccgcctcggcctcccgaagtgctgagattacgggtgtgagccacggcgccccacctttcaatgtttttttaagtgtagtattatgcagttgactgcaaagagcaagaaaatgaatccctagggtaaatgtaactttctacctcctcccccacctcaagaaattgctgcctctttttattgccccaccaagcagaagaccactggtaaatgtccttagacatccagctcagaagctattgagttcaccagaggcttttgtagtgaggccctagtgcacagccagcattagccacatacaactatccagaaataaagatcatatccttgtccttgaggggcttttgagaaatgggtatgtgcatttttggtacaagaccatgcagttatggaaaaggtgcaaaaggaatgcagaagggaagcttgggaagaattttcaggcttaatagtatttattctgagcttttagggatcggtgggcagattaacttgctagggctgctgtaacaaagcaccacaaactggtggctcacacaattcttttgttttccagttcttatcgaggtattagcagacttggtttcttctgagggctgtgaaggggtaactctttcttgcctctttcttagcttctggtaattggctgtcactctttgatgttcctaagcttgtagaatcattgccctaatctctgacttcatctttagatgatgttctccctatgtgtgtatgtgtctatctctgtgtccaaatttctccttttactaaggacacagtaatattggattaggatccattttcatgacctcatcttaacttgatcctcttcaaagaccctttcttagtccatctgggctgcataacaaagtaccctacactgcatagcttataaacaacaggcatttatttgtcagttctggaggctgggaagaccagggtcaagatgccagtaaattgggtgtttggtgaaagctcagtctctgcttcataaatgatgccttcttgttgtaccctcacatggtagaaggggcagggagcttccttgagtttattttataagagcagtaatcctatctgtgagggtggagccctcatgacttacccacttcccaaaagccccacctcttaatatgattccatagggcattaggtactaacatatgcattttgggggcacaccaatattcagaccatagcagacgctatactcaaataaggtcatatgcatatagctactggagtcattacttcaacatcttttggaagacaaaattcaatccataacagtgggagtttcaagtagaaaaagggaaggtgcttctagcctgaataacacagtgtaaaagacatggagccttttagtacctcctggtcatctcagcttctctgcacttggatggtgggactggaggccccccacccccaggcagctttctcagggttgcttgtagcaaggctcagggagctggttctgtcttcctgatattcttattatatgcccaccctgccagggtgccaccctctgtaactgccccaccctgccagtgtatgtttgatctcattgatctcatggtaaggattccttttatttgccttcaggctctcttttaactaaatgaaatacttgtttaaggcatttataaggccattgaactctttgttcatttttatctgcaagttaaaaaaagcatatcctgatttctaaacattctaaatattctccttttcattctcttttctgatcaaggttcatttgcaactgcttataagctcctaatattttaatctatcccaagcatttgttgatttttaaaaataaaattcaggagacctgctttatctaacaataattaatgctggattaaatgcacttaaacttaatccagttaaaatgaggacaaaaaagtcagagtgcaaccattagggagagactgacctacacagatgatgaggttggtttgatggatagaaataaatactagaattaggcagggagaaatgctggagtgaagactcatttcataaatagtgggttcgttattgaatattgttgtattatgatgacttttgcttctctatgtagactcttaacttcagggcctcagataatgaatacttggatagaaaggagcctctgaggtatagttggttgatttttagaatgactataagagtaatcatgcttcattttgatacctagtggcaacacataggatctgatttgcatatcttgagtatgcgggtttccaggtgaaacttttgcttacttatatgacatataggtttgtgtgtgtgtgtgtgtgtgtgtgtgtgtgcttcaacctcacactacttgaagatcagcacatttatggacatcatagttgagctcagtgtcttttaggccaccctaaaaatggtggtacaaaggaaatgttctcaagaagcactagaatcctaggtccctatacctggaggggatatggaggtgccatttagaacagttcctgttccctcacacatgtaggagatcatgctgtatcatggtctcccacacctctgtcctccatacagagatctctctggggaaatagtgtaacaagaactatgactgtgattttctttcggtagcattcttttttctacgtagtacagcttaacaagtttctatggagagactttgagaattttatactgttgcagtttccaaaagaattaccataaggctgtgttacacatctggatctgaactatggctgcccagttaagtagatatcatgctagccaataagtgttccaaggattctgtgtctccaaggacaaagagcacaatttatttttcttaaagggagaagtgagggagagtatgaaactagagaaagtaacattatggtgaaatttcagaacccagcattagaacagtggagagaatctttttggcaggcagcctggcctgagccttgcccttgcccttgccctggactcatctcactccaggactcatctcactccaggagcagaatgcatggttgttgcatgcgtctgtttcaccaccagctgtaactgctcttatcctcttatccattgtctttaccaagaaaatggaagaaatactacacacttcctatttgtttatctgtgagggagagtgtgaaagacagagcccattccccaaagaggtctgcttgtattacatccctcaaaatttctgggcaggaaattcaaaaccacaattgagaaatatagttaccaagagtgaaagtacaagttaaaaaaaatgagttaaaaaaaaaagacataaaaataaattccttaaataccagtttctggacacagacttctccagagttagcaagtcactgactgcctgtggctaaggctagttttgcatatgggagtagaatattttaaaggttctttttgacttaatgctgcttcaagagaaaacggaaaaaggaaagaaactggcgttttgtgcatcatttatatgccatgtattattctaggcactttgttcgtgcttatgtgtttaatccctaaacatgcaggtatgcaatgtttttctattttattggtaaggacaatgaataagaggataagaacagttgcagctgatggtaaaagtcaggcatgcataaccacggaccacactgctccttgagtggagttggctcagggtaaggggtgatcttagccaggccacccttggtggcatggctcaatccaagttcaaaggcctcagaaccagggaagccaatgatgtgattctcagtctgaggccaaaggcttgagaacccaaggtcattgatttaagttatagggtccaaaggccagggaacctggaatttttgtccaagaacaggaaaggaggagtatatctcagttcaacaaatagatcaacatatttgcattttctctcattttgttctcttcaggatcccagaagatgggatggtgcctgcccatattgaagtcagattttccccatctagtccacttagatgaacatgctaatgtcctctgaaaacatctacacagacataccccaaaataatgctttattaggtttctaggtattccatgttccagtcaagttgacacctaaaattagccatcacacaggggggaaaaattttaaaatatagaaagatgaaaaaccagaatttatcgaattactatgtgctatatgcttaagaaaccttacttgatatcattctcattataaacatacttgatattgcctttatgtagggaggaaattgaagtttataaaggtaaagtagcatacttgcagtcactcattttaaaagtgaccaaaattaaagtcaaatccaaaattaccagactctcagccccttgatttatgctggttctcgcataataccctatgaatcaaatgcactgataatataccatcattgtagctacacctgggtctataaattcacttgtagtctttgtagttttaatttcactcttgatttaaactcagaacctttttttatttttgcatgtccccaggctacatttgactagcttcaagtaaaaaacaaaacaaaacaaaaaacatactgcataaatgttatgtggaaataattcatttttgtgagtgcagtcttatgtttttgtttgttttagtgggcattattctccataatttttataattctttttatttgcagaagcagggtagacagattattatacgcaagtcatgcttattccatttcagtcatgaactgacaattaagtaaaatggaattcttaagagttggcacaaatatttatttgtttccaagttcaactggaaaatttaatgaacttgcaaatgtgggggtggaaaggatgacattttttaagatgatgatatgcctaaacaggtcttaataatacatgttttatcccttcaatttgaatctttccaactttaaaatgtcaacccaagcctgctggggcacatgattgcccctctcgacttactaagaaatgtagacaatgtgatattttttaggtttactttctgttttctattatgccagcccaaataaatgcattaaaaacaaaaataaaccctaagaagagagaaaatgttcgaaaacatttgttcccaacataattccacaggaaaaagtattagaaaacatgaggtcatatcttaagagaggatatagtgcatggtctcagaaaatagaagaaataaaggaaaataggtcctagaatgtgggctctctacatgtaggttttgatccagatttgtttcatcaggcttccatttgcttattaatgataaagtactgcaagtacctttactggtagagaaacaccacaagtccccatggactaatttcagctgaccctggaagcttctgcagcattttgggagcaccccagaaagtcacggtatgaagaattttgtgtacctgagccacccctcagcttgcttttctgtctttgaattgccatcagcaccaaatgaagctagtctagaatataaaaccaggcagcataccagtgtcagcattagagtatgttggttggaacagcacacaaatccaacacagagataaacaatcagaatacctacatatcagttgatcatgctgctcatcctctgaggccagggtacaagtgctttcaccattttccttatggttctttgtgctgtgaaaaggactttgtgagtgcagaatcacagtgaggagaccaaggttggatgaaaagtcccctgttttagcctataactgaataccacaaaatgggtactttattttgaaaaaagaaatttatttggttcatgtttctggaggctgggaagtccaaaagcatagcgccagcatctggtgagggcagttctatggcagaagggggaaggcaagtgagctcaggagacagagagaggaaattgagctgaattcatcctcttatcagaagcccactcttgtgataactaaccccctcctgtgataactaaccccctcctgtgataactagtttactctcatgataacagtattaatcccttcatgagtggagccttcattgcctaatcacctcataaaggccccacttcttagtactgttacaatgactattcaatttccaacacaggaactttgaggaacatattgaaaccatagcagctccaaatggagaagctgggtacagagtttggatgtgggtggggtcagaagcagatggtcaactcacgaaaggaggatgtgtttaagcctaggagtacctgatatcaacatggacagattctaagccttaagaacactctggggtgagaattgatgtaacatgaacaattctgtaaagacagaaatatgcatttgttaattcaagtaacaagtctgaagtgtcaatgatgtgggaattgctgcactaggtgctgaggagataatgatgagccaaatgagtaaattaatgaagaatatggtcccctgaatcagtggagcttactgtgcaaggctttttgatagtgcaaggctctttgaactagtgacatttaatttgagatttaaaaaaaaaaaaaaaaagtggagtggtcctttaaaagacaagcagaaggcgtggagcattggctcgcgcctgtaatcccagcactttggaaggccaaggtgggtggatcacaaggtcaagagatcgagactagcctggccaagattgtgaaacccggtctctactaaaaacacaaaaattagctgggcatggtggcacgcacctgtagtcccagctgctcgggaggctgaggcaggaaaatcgcttgaacccaagacagggatgttgcagtgagctgagaccataccactgcactccaggctggtgacagagcaggactctgcctcaaaaaaaaaaagccagcagaagaataaagcaaacagcatgtttcaagactctaaggactgaaatggtagacataacagaaaaaaaggagagtggttgatatgggtgagcagtgtcatatcaggcaggtctttcagaccatactaagaattttaggtattataagtcaaataggaacctaataacacagtaaaaatagaatatacacacatattcattcatatacatgcatatatatgatttaatttatatattaaaaggtttatattgcctgctacatggagaatggtttatgggagtataatcataaaagaagactaaaagataaaaagctatgtattattttatattctgcatattcgacatattctttgcatattctttgtattcttttgtaccctaggattaatatttttgcagctatagttgacataagataagccacctgtttataatgtatcactagatacatttttgacataagtattcaccagtgaaaccaccactgtaattgagacgattaacatgtctgtaactcccaaaagtttccccacatcaatttgtaatctctcctatcagtccctactcctgtccccaggtatctacatacatgttttatgttattatagtttccattgtctagaattttgaataagtggaattatacaacatgtaccctgtttgctgtctgatttattgcactcagcatatttattctgatattcttccatattgtagtttctatcaatagttcatttctttttactgctgagtactatttcattatatagaaatgtaataatttgattatccatttacctgttgatggatccttgggttatttccagtttggggggctattaaaaataaagtttctatgaacattgggtacccagtgaaattgaactttcaatagttgttggtaatggaatggcgagatcataaagtaggtatatttttaattttctgtgaagctactattggaaatggctatataattttacctttccatcagaagtacatgagagttctagttgttcacatccttttcacatttggtatggtaagtctttaatctcacctattctagcgggggtgccatatatctcattataatttaatttgcaatttaataataatgaacaatgttgggtatctttttaggtacttatttgtcatccagatatctttggggaagtgtctattcaactatgttttgctcacatttaaattggtttgcttatcttattattgagaagtcattcttataaattaaagatacaagtccattgttgaatacatattttgcaattttttcagactgtatcttgccttttgattttcataatggtgtctttgaagagcaaatgttaatgttgatagataaagtccattttattgattttgaaatattttctagtttgtagcttttatattttagttaagaaatctttgccaaatccatggcactaagattttttcctatgttttcttctaattttgtagtttaaactttacatttacatctatcatcctttttgagtgtatatatgtatagagtatgagattaggatccaggttcatttttgtggatatggctatatatactattgatgcaatgtcattttttgaaaatattctttcaccattgaattatgttggcatctttgtcaaaaccaattggccacataagtttcgaatattatatttcagaacgcttttatctgttgcaattatttatttgtctataattaggccaataccatatgccttgattactacagctttataagaaatcttgaaataaagtcatgagattccacaactttgttctcttggctacaggaacgttgttttggctactgtagatcttttgtatttccataaaacatttagaattggcttgtcaacttctgtgacaagaacaacaaaaacaaaaatgcttcctgagattttaatagcattgcaatcaatctgtctatcatcttggggagaattgacatcttaataatatcaagccttctaatccataaacatgttatatctatttatttagatcttcttttaagcttttcaatgtacaagacttgtgtgccttttgttaaattgatctctatgtattttacatgctttgatgctattgtaaatgacatttttgtttcaatttttctttgttgctgtaaaatgatgtacatttatttttgtatctctctcctataaccttgtatcctgaaattttcctaagcttacttgataattatactaggtcttctgtagattccatcagcttttctgtataaattgtcatgttgtttgcaaacaaagacaacttttcttctactttccccagctgaatgatttttattcctattttttcttgttacattaactaaacctctggtacagtgttgaccagaaggtatgagagtggatattcttgctttattcctgatcttagggaaaaaaacattctttcacagctagatatagattttttatagctactctttattaggttgaggaagtgccttctatttctaggttttgagagttttaatcaagaatgaatattaagtttggctatgtttttgcctctgatctagttgttaaattatctgcttagatgtaaaaatggtgaatcacattgattaattttaaaatattaaaccaaccttgcatttttgtgtataaaccttacttagtcatgatgcactatactttttatatattgttgtattttatttcctaaaatttattaagatttttgcatctgtggcaatgagggctatttatctgtaatttttggttaggtcttcgtctttttcggaatcatgataatactggcatcataaaatgaatttgaatcgattgtttttctttaattttcagtgatgagaagcccccgagatgataggaaacaatgaacaccaaaggaattattattttatttaaaaaatagtgcttgctataattgaataatgttctaattttagtatgcatgagaaatacctgaaaattttacttaaatagagatcctggctgggtgtggtggctcacacctgtaatcccagcactttgggaggccgaggcaggcagatcagctgaggtcaggagttcgagaccagtctggccaacacagtgaaacctcatctctactaaaagtacaaaaagtagctaagcatggtggcaggtgcctatagtcctagctacttgggaggctgaagcaggaggatcacgtgaacccaggaggaagaggttgcagtaagctgggatcacgccactgcactccagcctgggtgacagagcaagactctatatcaaaaacaaaaacaaaaccaaaaaaaaaaccaaaaagatcctgatttagaaagaaggaaaccataactagtattaacaaagaaaaacatatctcctcaggtgattttttatgtagatgattcatgttttgagaactcttagtctgctcaaaagttctcaaagtgtgtttctcagaccagtagcatcagaatcacctgggaactttttaaaaatgccgacattctgtactcactccagatctactaaatcagtaactctggggaaagaagtaggtgcagtctgttttttattaggctccaaggtgactccagtgcattacaatttgagaactattgttctatgttaatgacacagagagagaatgtatatagatgcaattaattttgtatatttttagaatatatatgtgttaaatagtgggaaatttcctctaaattggctgcttgtttcttatgacctgtatagaaggtctgagagtgagagagggaaagttgtgtcaggtgtgtgagtagtgtggagacgatatggctgatcattagggaaacaggaaggcaggctgatgacattgttagtgaccattagatgactacttaagctctgtgattgctgttctttattggtgtccatttgcccagtggtacagttttcttcccccattctgagctgcccacagtagaggtatggagaaggcagtttcttggatttgtgtccatttattttgccaaataggtagaagggaagacaaaagggataaagtaaatagagtatttgcaagagagtaaatgactgtagtcatggaccatggtcactgtcctatataaacagaaagatgaagacaagacgaggataattaacagagaaactgctgggttctacggatacaaagtcttgatgagatggaagaattgtttaggtagatacaggttaagaaaggacctaggagtataaatggtagtggctacagagtgaaatgtttgtttttgaattattgtcattttcgtgataagctacaaggtatgaccttggtaatagaggctgagttctactgtgccaaatcattggtattgagaaggacagagactgggtgaataaaatacttacgtgcctattgattttttcttcatgagtgatgtcaatcatagtgatagtaggaagaatgggaggctgacagccaaggactaaatcagaatcagaaaacacaggggcatcagcaccacagaaggtaaattagaaggcatcactgccacaggaaagctcagaagcacctgagtttgtttctctagctgattaatttgggccttaccacaatttcacaggcttatgtccccagtaaatcctaaagtcatagaatgtcttttgatgataaatctgtaatcgcaatatctgagtatgagttctgatgtagccatgcagatacaaataatagcaaccagttatcctgtagaactttgcaaagtaattgaatcataataagttccttgttttttccctatttatgacagaaaccaaaaagttggctttgaaagactcctaccagctcagaagtacatggatgaagatagttgctgatgcaccccgctagcatccattctaattttgtttttcaaattcacagagagtgaagaagtttatcaaaggcaggtgctgtcaatttcatgtatcatctttggaattgtcatcgtgggcatgttctgtgcagcattctacttcaaaagcaagtaagactatttctctcaagtgtttaaaggttacttttagagaaagcgctttgtgttactttaagttctcagtctgtgtgccacacagagggaacctgtggaaatgggtctagcaacaatctgcaagtgacttaggacatttttgtaaattgtggtgagtgtgtacaggcatgtacatgcatgtatgtgatgtgtatgtgcacacatgtgtgcgcggtttatctacgatgcacataatgatcattcctctcagtgaccacgaacattctatgttctttgcactgattcaccacttgctggtattaagggcttggtgtctgcctgtcactaaaggctaactcttctgaacaaaggggccactgctatgaacctgcacattatcaaccattatctatctatttctgaaaaaacaattcagtttttcataaagattttaggcaaatgtggaatatgaatactaaaaaatatacttcagtttaccagttggtatgcacatgttgaatatgccctaaagttaccttgctgagaaactagaccttcttcagataaaggtgtttatgtttgactagaaatagatgtaggccaggtgcagtggctcagcctgtaatcccagcacgttgaggggccgaggcaagtggatcacctgaggtcaggagttcaagaccagcctgaccaatatggtgaaaccccatctctaggaaaaatacaaaaattagttgggcatggtggcgtgccactgtagtcccacctacttgggaggctgagacaggagaattgcttgaacctgggaggtggaagttgcagtgagcccagatcacactgctacactgcagcctcggggacagagttgtctcaaaaaaaaaaaaaaagtagatataaacgtctctctctctctctctctgtgtgtgtgtgtgtgtgtgtgtgtgtgtgtgtgtgtgtgtgtgtgtgtatttttccaaatgaactctggtagacgtatttcatttattaaaatgatataatctgcacttaagaaatgcagataaaaatattagccccttggtttctcatgtcttaagaattttgcacagatttggttcctacagcttgtctgaaattcaagccaatgtgtaattgcttttcagtggacctataattttttaccaatttgctcttctaacatgggattaatttccaggtatagtttgtgatacctgtctgcatgttatctgtgttgattctcaaagaaaactgtgattatgattttttaaaataacagaaacttgagcatcaattcagaattagtaactattatcttcctaataaactatttcagaatgttttttagatatttagaactgttgcaaaaatagaacagacagtttctatataccttagaccaaagttcctccattattaatgccttacattagcatggtacatttgtcacaattaatggaacaatattgatatagtattactaactaaagtctgtattttcagatttccttagtattttacctaaggcccttttgttaatgccagggccccatccttaccatatgatattagctgttacatctcctaggcaactcttggctgtggcagttgtaactatcaatttctgaacacttactctttgccaggcacactgggcttcttatgtgttagcttccaatcaccacagaaatcagagttgtgcattattactgcatttttcaaataataccagaatttattttaaaatgtttatttttcaaagtcataaagaagaaaatgacagataggttctttaattttaggagttctagtttaaatcacatgctctaaacctctataccatactggttcacatagtccttctgctagatggtggagctgcgcagagcgagttaggagttactctcttttgtgcagcccatagcactttatgttctccaagaatgccatctggcataatggtcagggttgtacactagtgagtcatacttggattcaaatcttcaggctgtcatttacttgttatatttgattaggcaaattatatcgtgtctcttagccttggttccctttgtggtaaaatatgaacaagtataatatctaccttatagaattttgttaaggattaaatgcaatcatggccagacgcggtgactcatgcctgtaatcccagcactttgggaggctgaggcaggaagatcacttgagaccagcctggccaacatggtgaaattccatctctactaaaaatacaaaaatgagccaggcatggtggtgagcacctgtaatctcagctactcgggaggctgaggcacaagaatggcttgagcctgggaggtggaggttgcagtgagccaagatcgcacgactgcactccaacctaggcaacagagtgagattcagtctcaaaaaaaaaaaaacaatgcaatcacagtgtaaagggcatagcaaagtgtttaaaagagtaaatacccaatggaggcttgctgtcgttaacacccatggttttccacactagaacttggaggctgggtagctataaagttaagagcctcccctggagcacgagagtggtaatcacacccagcagggtggtagttagaagtgtctccctgctagagctttgtacaagaaagaaattccttacttaacaataaccaaattacaataaagaagcagttaatcacttatttttacagtataatgtgtagttgtaccacatttaaatgaaagacagatcatggtaattatgaaagcaaacagctggattaccaggggacttccatctttggggctgtcaatgtctcactctggacagcaagagggctctgagatcaacatctcctcctgggactcagtgaggagtcaaagtgtttaatgaaaacaatcttcaacatcagattcattagggtaggctcagaggactgcacagaagctagagcaccaagcgggacattgttatctttctgtctaccagcctgggacacagttttatttaaaaaatgaatcaattaataactaaaggcaaaaatgataaaatgatgatacaaatggaagtattttccacctgaaattggattagctatatgttcctcattagaggcctagggtgcatttccttcttctagtaccattttcaggcttggtctcccttttttttctttgcttgagagaaatgccaccaccttaccaagcacctaatttatattgctaaaagcaatatagattgtcataaaaccctggcacaagttgtgtgtgtgtgtgtgtgtgtgtgtgtgtgaattcgtggatttccttttccaaaaccttggggagaacagaatatccaaactctaccttgaccttcccttactttcactcataaaggaaagtagtttatatgcatatacattttttactttagcttagaagccccaagtcttccaggattctaaggcctctctatcactggtattcaaataagttcacttgaacctccattcgatacactgggatgtatagtttctgcccagagggagctgagacttagctcaaagctctcttgatcatttatgttctacttcccataatcacttagaccttgcctttatgattctttttccattccctcgtcacctttggcatggcatgacttcatcagaaggaatattacagcaaattctgtgtctgaggaaagatggaaggtaggtaacatgataaggaataagtaagaaacaccttgaatttagaggattttttgatggagttaactgaacccatagcaactctaaaaaacagtgaaagaaattctcttcactcccaataagctcatatattcctatacatagttaatagaactattaattgagcctgtcaagtctggccagtgtggctcacgcaatgactgtaaattattcaagtttttctctttatttttaacttatgtagttaagaatgatggggatgagtgttagagttcttagcagagcttggaaatacaaaatatgattcaactctaaaactagaattgaagtaggagaggatatgtttcaggaggcagaatctgaaacaggtaattatcacaaatgggaaaaaagaggaggataaaaactggtattatcagtaaaatgtagacacggtaacaacctgcccctaactataggtcatcaaccccttgaagtaagagattttagatcccaaaaaaagcctcttaatggcagacactctgatgcactgctgcgtcttcttcagatatggaggatttagtcgccaagtttgccagcaaacaccggtgaagagtcacctttctcaatctcatgttccattctggtattgtttacctccaatgatgcatcgatatgaggctctgaagacctagaccttttccccaacttcaggtgcaagaccatgccagcttcagagctccctctgaggtttgctgaggttttcactgagactgtatcacattccaacttctccccagcccaattctgcttccatttcttccctttgcttccacaggtgttgataccaagagctctccttaacaaaagtcctctatgctgtctttatcccagggtctgccttcccaggagcccaatctgcaacaagacaaataatgcctaacaatggattaatgatgtctactattctgcaacttacatctcatttctttctaatgcattggaccagagaaatttaaaactcaaatgaactgtaaagtttccacactgacactgttgggctaatagtattcccatgtgcaaggcatgcatcttttcttccccagagcaatgcctctcatgagagagctaatggtattgcaatcagctgctgattgttttctctgttcccattttctgggtgaaggaagaaagagcaaaaaagtgtgtgcttgtgagagaggagggatggtagataggcagaggcaggctcagaatggaaggaccacgtatcttggaatattactaagtcaggacttgagtgaaaaaagactaaaggtaagcaaattataaaaggatttaggaaacgcagtccggtattggatattgcttaaagaaaattcccttataagtttatacttccaagactctgaattggattactgcaaacatcattaagtgtttctaatttaatcccatgagagtaatggaatccttgctctgagacatgcactcttactttttcaggatgatttaccagactagaacctcctgatttccccttttttgtgtgtgcgaatgaacccctgataaaatcttgtggctgtaacatgctccttaaaatgctgatatgatagatttatttttaacaataggctatagattagctgttaggaagcaaatagattattacaacaggattaaagcaactaagagtgctagagataaaagtctcccaaataattggaaagataaaagaaatatcttaaaaaacagagctacatcacactgatattgtaaattcaaaatgggtaatgaagctcaaagcctccaaagcttgcagcaagtgctggtgaattgcttgggaagatgcaactagtgtaatcttttacctttgggtcaatgttctgattcttttgcagcttctgctcacaagactgagcttgcttgatggtatcgggaaagatatgaacattttgcgtgtgcctccacatgcagccaccacagtgtccgtggaagatagcttttatgaacttcatttacagaggaggaaatggaggctcaacaagtttaggaaattattagggtagcaaaactagtgggtagcagagtgggattcaaatcccagtccctgtgatacaataagccacgctctgtagggtgctactgactggagaagctcattgctaagaccggccatgtgctccactgacggcactatctttgtcagagacgttggaagacaggcaaaattcaagggcatgattctactgggaaagttgtcagaatcaaaatggagtcatttgtgttaaaaaccctgacaaatagagccggagaaggacatgaagggagcagtcacgtaggcaaatgcctgattacaagaactatcacaaaagtctgtgaaaaccgcagctttgcatgaagactattgcagccttacatgcacgaaaatagttctgcaaggacatatgcccagcaacttcctgtccacccttggactggcaccatcctttctattgatccttgtagccaaggatagtgatctcaaatcagttgtgtacctaacgtttcctgtcttcctagtgataaaacatagtttcctatatcgtgtgtattcccattgcaacacttatttccaaataaatattttcttttagagtctccatgtttgttatttaggtcaacactgcaaagaggtgtgcgtgtgtgtgtgtgtgtgtgtgtgtgtgtgagtgttgtgtttaatgggtaccaagtctatgctaatagatgatttctgtgaagcttctgggacagagctgctgctaaggcagtggtttgtcccatccttctggtgtaggcactgagtgacccagacaacagtcattccgcatgtgcacacaggagcactttacttgaagtccagaaccctacagcagtttcagccttttcactcagaagcggtgggaccatgagcacatggcttggcaattctgagtggtggttgaagagtgtaaactatggaggcaggttggctgggctgagatccaatcgctgccactcactgactatgtgacgtcaaacaaatggcttagcttctctgtgctttagttctcatctacttaatgggtatagcattatggcctcatcacaaagaattatcatgaaaaatctgtgaaatgatacatataaagcacttaaaaccatgtgtggcacattactgtataactagctctttaagagttaactatttttaatatctgggctcttggtaacaataaatgagctatttctaaattgtaaaagacagagaatatacacattatggtatatagtcaagttgtgcaattaagctaaacatatttgaattgtacaaatataaatgtaactctacaaatatgtcatatgtacctgctaagcccaagtcttaattgttttcctctagtcactttcccatagtatttccagttctttgcagctaaaactcagggttagagacttcttgcatctatgggggccagggcaatgcactaaatgtttgtctgcttttggggtgccactgaatgtgaattcctagagaatatggatgatatcaggttatcactaaactggaagtatttctggtggggttggaaatgagagaagggttctcttcgttagctgagtttatttaactttagcaaataacaaatatagacactgggaatgaatgagaccctgaaagtaggagttgaataaagtcatgcaaatatttgtacacgtttatttatgcctgcaggaaacaagctaaacaaatccaagagcagctgaaagtgccacaaaatggtaaaagctacagtctcaaagcatccagcacaatggcaaagtcagagaacttggtgaagagccatgtccagctgcaaaatgtaagtgacatgtctacacacctcctcctatagcctacctcagtgcttccagctcagaggtgttgggagcctgggatcagacttgtaaatatttttcagagctttatagggttttgcttaaatcgttttaacagttctgggctgggacgtatgcacacatgcatgtatgtatgcatcagataaaaggcaagttaaatttcagctcttgattacaatctgtaatataaactaatctctagtaaaaataagagcttcagttttttgtcccatgaacacttgttgaatccttagtttgtgccagaagttgtatgtgacaccaaggatacaatgtcccttgccataagggaagttctatgtaggaagaaacacaaaaacccccagaatcagaagaagtgagttccgagatagttgttgttgcagcagaggttggacaagaggaagccagtgggaggtggatgggggtagacttgggggctgcctcacaacagagtcggactcggactgggtttggaaggatatgaaaagttctatagagagtcaaagggctaagagctagaagccagaacatgcaggaagaataaagccatggaatcctaaaaatgcatgttatgttcagagaactccaagttaaggggtgtgagaagaatcaaaggtgaaaggtggagtttcataatcaatccttctaattccaagccttacagagatatcagaacttgaagttaaatgcaaactctttgcctcttacactttttgtaaggcagttttaaccattactgaggtatattgcaaaacactaaattaaagcaagagaattctgtgtaatacatgcagatatattcctcttaggttagcaattctttgaccccacacagcatccgcactttcagaatctgaggcataaaacaaaagaacaaaggccattgcataaacctagcatttgagtataataggcaatcatccaggacacattcacacccctccaaatgcttcaatcactggaaatttatacatcactggtgattctaagaaatcattacccaaaaagtcgctattatgatgtccataacagatgtactcagatgatttaatgcagaattcataaatcagagtctcttcccaggcaagttttgttaaacttctattcatggcaatgtgcaggaattgttcatttcagaaacagagtgaatggttttgctattgatttctaatgggtataatcccaccactctaaaacaaccacagtgatggagggcttcattccttagcaactggttatgtcaaagataaacaaagccagacactagttaaagtgatgaggatagattctaatcagtaacatgttagtggaatagttgaactgaacttctatttgtacggaaatggctggatttttttttttttttttttgagaaagaaagaagtaaaattatatttgtttgtaaatgacatgatcttctgtgtagaaaatgtcaggcttctgagcccaagctaagccatcatatcccctgtgacctgcacgtgcacatccagatggccggttcctgccttttctgatgacattccaccacaaatgaagtgaaaatggcctgttcctgccttaactgatgacattctaccacaaaagaagtgaaaatggccggtccttgccttaactggtgacattaccttgtgaaattccttctcctggctcatcctggctcaaaaagctcccccactgagcaccttgtgacccccacccctgcccaccagagaacaacctgctttgactgtaattttcctttacctacccaaactttataaaacggccccacccctatctcccttcactaactctctttttggactcagaccgcctgcacccaggtgaaataaacagccttgttgctcacacaaagcctgtttggtggtctcttcacacagacgcaagtgaaagaaaatcccaagagtcaaccaaaatactgctggaattaataaacacattcagtggatttgcagaatacaatatcagcaccaaaagttagttgaatttccatacattaacaataaacaattttaaaagaaaattaagaaaacacttccatttgctagagaacttaatgtaagaaacgcttaggtataaacgtaataaggtgaaaagtttgtaccttgaaatctacaaacattgatcaaaatgattaaaatcaatagacatacaacccatattgatggattggaaaaattaatattgttaaatgatgatataacccaaaatgtggtttaaattcaacacaatacccataaaaatctctatcagtttttgttaaagaaacaaattaatataaatgcattgtctcatttagttctaacaattaatttatacccacaatgtgcagaaaatagaaatgggatttggagcttgagaaaggtatgtctgtcagacagctagtaagtagctgaaagacaaaccaacatccttataactcagtggttctcaacagaaggcaatttgcccaccatcccttgacatttggcaaagtctgaagacactttggctattgcatgctgggagaagaatgctacaggcatctagtgggtagcggtcattggcgctgatgaacatccttcaatgcacaataacctccctcaacagaagattatccttcccaaaatgtcaaaagtggtaaagaagttcacagtccatgctcaagtttcaaatgggaccatggggaagttctgaacaccaagttccatcaccaagcttcccaccgcaggcatttatttccactttacagagggtgacgggttattcaggcatatttcatccttggaaaggaaaatttcctacttgcttaccatatcaggcaaatctgtctttgttttatcttgaagctcatgttaactacttgaaattctttgcaaattgcagtgtttaacaaatgaattgtctggctctggcattcctttattaagttcattaaacattcatggaaatgggtttcactttatagtcatctaacaagatgcaaaacacctcgtcaagtgaagcaacatgatactctggaaacacttgactccaaggctgcagaactggagtagattaccctccctgagaagcatctagtccctaccattgttttaaaaacaaataaagcatctgtgagtaaagatgaactcacctcctttgctgtgtctcaagtaagaaagagctaaggatagaattataacctctagaaccttcaaggcaaaggagtgaaacttctcagcctggtttagggatcagaaaagaaagtcatcaaaagagatcatccgttcttctctcttaaaatcaagagaaaatattcacaattgaaaaatgaaagaagaaaattgtatacccttcataccttttttttcagtaatcattttaagaaaggtaagtttatgggggaggtaacattaaatgagaaagaactggaagataatacttgcatgctaaagaggaataataagaatttaatgcctaggccaggcgcagtggctcacgcctgtaatcccagcactttgggaggccaaagcaggtggatcacctgaggtcgggagttcaagaccaccctggccaacatggtgaaaccccatctctactgaaaatacagaaattagccaggcgtggtggtgggtgcctgtaattccagctactcgggaggttgaggtgggagaattgcttgaacccgggaggcagaggttgcagtgacccgataccatgccactgcactccagcctgggcgacagagtgagactcagcctcaaaacaaacaaacaaaaaaaacaaaaccaaaaaagaatttagtgcctaacagagccttaaaaattggtgaaaaggcacatatttatccagtaatgtttattgaactctggtaaagcccacacttctctgtgttgggtactgcagggatagcttagaatacaaacagaagaagtggttcctgatctcaggatgttcaaaggttagtggagagaaaaatgtacaagcatataatatctttattatatagatacattaaatcaaagtactatcagagaatggaaaacgacttctgaatttgactaggggaatctcaagcctacctaaaggaggtcacatgtgaattgagttgttggcctaaaggaaaacaaacaaaggaaacaaaaaacctaggcaaacttaatataaatagagcaattattttggccagttttgaggactgcaacctgagagcatagacttaatgtaccctaaatacatgctcccatcagcagcagttacaagtgggtttttataggaaatgaagaggcagttcccaaattgtttatcaagaatttgcattaggccgggcgcggtggctcacgcctgtaatcccagcactttgggaggccgaggcgggtggatcacgaggtcaggagatcgagacaatcctggctaacacggtgaaaccccgtctctactaaaagttcaaaatattagcctggcgcggtggctgacgcctgtagtcccagctacttgggaggctgaggcgggagaattacgtgaacccaggaggcagagcttgcagtgagccgagatggctccactgcactccagcctgggtgacagagcgagacaacgtctcaaaaaaaaataaaaaagaatttgcgttaaaatagtataagctattgcttggcttatccatggttctttttattacaaattccaaaaacttgaaaataagtgatgaggcagttaggaacaaaatgtctttaaacaatcacccctgggtttggtgggggtgagtgactacaatcccacactctgtctctctgggcctgataaattttgcatacctcatatagctcacactgctctgagctatttttggtagagttttgagagtgaattgaaaatcatggaattgtttgcagggagtaggtcagaagaggtaattttgttgtagcattaattaaagttaatttttaatagttctagcctaaacgctgatttattgctttaaatatcaaattataacttattgattgaatatagattcatacattcatttatttacttaaatatagactaaagagcctactaagtaccagacaatacctattaaggaacaggcatgtgatgatgacaaaaaatgagaaagctgcttctttcaagaagtttgctgattactgcgagtgatcaatataaatcaaataatctcacaaatgtgggctctcatctgtgccaaggcctacaggaaatagtgaacggtgctatcagagcttatagtaggcaggctggggagttcatatcagaccaagaatagctcagctctctaaaaaggtgcagttaacacatgaagaatccccctggtgaagtggtaatttgctggggaggaggtggcgttttgtgctgtgcctagtgtctgaagagggtctcttttcatattattttgctttaaaggaaatgtgtgaaaattgcaattcttaaagttcttgctgctttggtgtccatgcaaaaattctcaacagcggtcgagttgtttttaattacctacattagaaatcccagtgaaatcactcttgaaaacatattgtaactatcaatttccccatactcgggctcataagtcagagtggcaataaagaaaattttgtcacagacatatttgaaccaagcaatgcagagagaaagacatttaaaactgcctaaaaatatcctcctcctgcttttattgcctagggttccagaccaggcgattatcagcactgtcaacattgctgtccaaaactgaccctactttcatttaaccttctgactcctgctgtgtgcatgtggcagacctggaaacaatgctgttattctactgccaacatgcgcctgcttcatttgactggcctattgatttcggtgcaccacctacaatgtgctaggagcaaagcaggtgggcgggcaagaggagataccttcattacctgggagcatttgcattagccggcactttcaggggggccagttggatgaatgcttctcctaggaaataacaatattaaccagggcctatgaaggagttaacaacaacaacaaaaaacacttgagctaatgctgagagcaccattgaatgaactggggcatctccttattcactgctaacaggatcttttgtatattataccaaatgagctcttaaccatgtgcacacaataaagtcaggatctgtgtcaaggaaataacatagaatcaactgccaggctttgtaacattgtagaggatgctaatagggagatccagacaggcagctaatctgagcacttaaatttcactgaagatacaatcttaagaataagtttgtccagaccttagcttgtctcggagatagaactgcatgcatttggatggaaacaaaataaatatttttgggctgggcactgtggttcacacgtatgatcccagcactttggaaggcaaaggcagatggaccacttgaagtcaagagtttgagaccagcctgcccaacatggtgaaaccttgaccctactaaaaatccaaaaattagccgggcgtggtggtgggcgcctgtaatcccacctactcaggaggctgacacatgagaattgcttgaacctaggaggccgaggttgcagtgagccgagatcaagacactgcactccagcctgggcaacagagtaagactctgtctctctctctttatatatatatatattagcacagagcataaaatgtccaaaagctatgatcatggtcagtcaggctaactttccaggagggttggtataggtgaactgttttgctgagtggagtatgcatcttgagggcctacacctgagctactcaagcaattaagggaagactgaattctgcctttagtctctcaattctttttgtttatttcgatgtgtacttttttaatcatttatgttattttctattttcttaagcagatctgatattttaggatagctttcaatttacagaaaagttgagaggataccacagcaagtttctatactctgtattcagtttcccctattattaaccttgtatattagtagggcacaattctgaaactaacaaactaataagaatgcattattatccataaaatcccacatgttggcattctcacaattgctattgtttattctgattttttgagtgttcacctgattgctgcctgtgttctaatcccaggtaccgcattacatctaatattcatgtctccttaggttccccttacctgtgacagtttgttgattttttctttttatgatgaccatgacagttttgatcagtactggtaaagaattttggaggatgcccctttattggaatttgattcttttcttatgattacatggggtttactggttttctgtagaaatttttaaagtgccatttttattatgtcatatcaagatacacgctacaatatgatttattattattgaagtttaccttatcatctgtctgaggtaatatttgccaagcttctccactgtaaagttacccttttcttctctctccttttgcatagaatactctttggaaggaagtgattatgcatagcccactcttaaggagtggggagttacggtcttctttccttatggttaagtatctacataagttatttgggattctatcacaaaggggttgtctcttctctcccatttacttatttattccatcatatatttttatcagtataaataaactcatggatactattttatactttgatttgtaatctaagtagtaaatactatgttacgttctcatcagttttttctggctttggccattgataggtctttcagctggcttatgtcattttaacattatgtatcaattcactgtaagttttcagggtttttttttgttgttgagcactacaagacactccttgcttatgttgtacattttctgccttggttctagaatcagccatttctccatggaaatagctagtttctttctttgcagaatttcattggagactgagatttggaagctaggtgtgtatgttattgttgctacagggatgtcttttcttggccttctcaacagacagatcaaagattttatatatatatatatgtatatttttaaataatagatatattaaatatgtctacttaagacatatttaaataatacatatattaaaagatatatttatatattgaaggttgcatatagactaacacatatctaaatttttctatgtaagcatctgtatctgtattctgctaaacatgtgtctacattgatgtctacccccaaatctaatccataactacatcaataattctaccctcctcccgttgcttatttataaatttccactccaacagtgaaaaacctccttcccactgtctattattcatttacttattttttcagtgacagaatacacataaagcattctcacaatggttataccatacctttgcactgttcaactttaatggctaggcggtgcatttgggcggtagttttgcctttagtctgctgaacacttgtgaccttcagaagtgtttcttcactttttttcctctcttacgtgagacggaaaggctacagggagcaggaattggggaagtgccttctttctggtgagataaggctctggtaaaatatttttactacaggagtaggcaattgttattgagaatgctctgtgtgcatttcaaaatagttacttttccccttccactggcagagacattagatgattttttttgttgctgttggggttctttgctgtgagaacctggtgtggttcctggaggtcaaacccatggaagtatcggcattctgcctaagactacagaccccaactctcgttctagtgcccatacagattccagcaacttgtccaaattacttcttaaacattcctaccaatttatggttccagcagattcagttgcagaaaagctgatcttagccattattctctgtattcacctgtttctccagatttaaggtggcagtgtgcccttcaacctcaattatccaatgaatacaagaagacattttcagtttgttcatttatttttcttattgctaggacaggaatagcgacttccaaactcttagcttgtcaaaactgaaaccacagaagctatctgaattcatgttcaacaaaaatgtatggaatataatttggaagttggtcaaattattagactcttatcatgcttccacaagtttcaagcaacctccggataggaataccagcaatttaaacttgaatttcaggtacaagtagtcactgaaacaaaatgctgtgagagaaagaaaaaaagttctaaaataataaattctggaaacacatttatattaatggaccaaaataatacaaataaaaacaactgtttaatatcgcaataattcaaacatatgaaataacagatttaggaaatatctatcatgaacactatgaataaacagaacaggttaagaggttaattctgtttatgagtgttatccggaattttggacaaggccctctatctctcagattctaagcagagactatgaactaatggtacaaaagatgaattaggctttttgacaaggaaggaagggaggaagggaggcagggagggagggaggcagggagggaggaagggaattactgacttttagtgatttggcagtttctctaaaagatctgcatgctccagaaatagttggctgatattgtcccctggcagcccgtattagtccattttcacacgctgataaagacctacccaagactggatgatttatgaagaaaaagaggtttaatggactcacagtttcatatggctggtgaggcctcataatcatggtggaaggtggaaagcacgtcttacgtggcagcagacacaagagaagagagagccaagtgaaaggttttcccttataaaactatcagatctcatgagacttattcactaccatgagaacagtatggaggaaactgccgccatgattcaattatctcccaccaggtccctcccacaacacgtgggagttatgggagctacaattcaagatgcaatttgggtggggacacagccaaaccatatcacagctctctgcagttgctgaacatacttgctttcttcagtttgtcatggatttgcccagagcatctcacttgtttttgtagctgggccttctaggcacctaggtttttcttgtaaaccagtttattagataaaaaaagatatgtcttttatatccctcatatgtcttttatagacctgaaagtcagacagatattcaggatatcatcgcactttaataaacatgtccattcatctgactttttccatgggtactttgcaatacacaatcaataatgaagcacacatagaggtatttccattatgtattggatctttgttatttgaggttgttgaaaacaatcaccttttccaaattatctctgtaccttctctttgttctctgtcattttcctccattttgcaaaaagactgaccagcctttataggtccactgtgaaaaattcggattctggttcaagacatggtcattactgccactatgtggcttgttttggaagttattgaaaataaaacatttaattggagcttttgaacttaaagctgcaaaaccttgatatgttccctagtctccatagcttatactcatggatatactttttcccaagcataacacctaattagatagttaataatttcttttaacttaaaaatctgcctcctaagtaattgcgtgagaaacacacacatgcaaatgcacacagaaaaatatatgtacatacaaaatctgtatatatataaacaccaggctaattatgtgtatataaacataaatatatacacaatctatttatatctattaattgcaccttccttatttacacaaatggatttatatgcatacgcttttgcgccttttattcttttcaatggctgtgtagtattcatttatggacatttctattgttttgagtttttttcacttttgtgtttatttccgtttcgttatggacaattgtgctgctgatgtaccctggaaattattattttgaacttttgcaattatggaaatttgcatgatagaaattctaaaagtaatattttggatcaaagagtatgtatatctaaaattttgaaacatattgtcaatttgctcttcaagttagcaccacggctacttttccagggccttttcctttatcagatattcttgaaatttaaatttctctatttattttaaaggcagagtcttgttatgttgcccagcctggagtgcaatagctaatcacatagcacactacagtctctaactcctgggctcaaatgaccctcccacctccacttcccaagtagctgggactacagctgtgcaccactgcacttagcttaatttcctctattctgattaccacctctttataatgagtgcagttgcactctttgccatatgtatgttgcctgtctttatttttctgtgaaattcttgttcacctgttgcctttcatttttttccagttgatttctgcctttatatcttaagaatagtctttaacataagaatagcctatgtttccccaggcttttacttatattttgatttactaataatcatttttgttacttaagacatttaaattagtagtaaatcaaattttacatatttttttctttatggtctctaggtgttttgtcctggtaacaaatgtctttctcccataaggttaggaatacatctcccatatagttttataaaggtttttgaatgtatttccattatccaaagagttcattcatatcttcttgtgttagtctgtttgccttgttataaagcaatgctgaggctggttaatttataaagaggtttatttggctcacagttctgtaggctgtacaagaagcatggtgccaacatctgcttctggtgagcatttcaggaggcttctgctcatggcggaagggaaaggggagcaggtgtcacatggtgagagagaaaaaagagaaaggcgaagggtgccatgctcttttaaataactagttcttccatgaattaatagaatgagaactcactcattactgcagggaggatacaaaccattcatgaagaatcaacccccatgacccagacacctcccaccaggcctcatctccaaaattggggatgaaatttcaacacgagattcaaaggggacaaatatccaaactatatcacttctctttatcaaaatctaaaaatataaattgaactaaaattatactttactgttatccatagttatgttccttgccacaattcataggtaattaagttatgacaatgttaatggtttataattttcgtgactagttgagaaagccgttcttttttttttttttttttgatacagagttttactctcttacccaggctggagtacagtggcaccatctcggctcactgcaacctcaatctcccgggttcaagctattctcctgcctcagcctcctgagtagctgggattacaggcgcatgccaccatgcccagctaatttttgtacttttagtagagacagggtttcaccatgtttgccaggctggtctcaaacttctgacctcaggtgatctgcctgcctcagcttcccaaaattctgggattacagtcgtgagccaccgtgcctagcctgagaaagcctttcatagtgaagctttgttgttaggtagataaaaatttatgaatatttatcacttggtagattgctcattctatgaatatgaaatatccatctttcttccttttaaaatgcattttatacataattatattttatttgaaattattactgttaaaagctttttcacctgtacattgcagggtatatctttaccaattctgtcgacttttttctctgttgtttttaaattagctctttcagaacatagaagaccagatattcagtgtatgaatctgtcttttaatagttaaatctaaccatccacagtttttatcatcactgatagtttcacacttattcctgtcacatttatttccaatttaccatgctctcttgttacaaacccccttattaatttttgttgaattaatattagtttagttttttcatgtattgtatattacacaattcttatattctagtgctgtctaatttctaatacttaaatatatatattttgttcatcagtgtctaaaattaatcagcatgcatatattacattgtctttattctcaacaatcccagctaggattttttgtttttaaatgttcattcttctctctttttatgttctttttcttatcaatatcttccagccatgttgaaattctttggactttactttcaagcattaattttaaagccgacattttaagaaagagcttacaataaaatatcttccactccttcctcctggattcatttttcttcggttagaactatttctttctccatttcttacttcataagtcatctttagaatctatgtaaatataagactacaagcagccactaccaattgattagaaatggtacttagggtggaatttatctttagttttttatagttcagagataacatttctaaaaggctaggaaacatcttagagtatcatcttaattattgtatctaccttctttttacctggatcaagtgcattaagtattgtctgtgaattttttcaacaaccctataagagagattttattatctcaccatatagatgtgagattcaaaaaggttgattaacttgattttttttatcagtgcttctaatactggcttctttgcttttgaaatgagaaaaaaaaaggtatactgagttttagagttttacagttactcaggttaacacttaaaatctgtagcttgacacattgggtactgaatatccagattcaaaactctcttttattttgattagcatccttaaacttctatttctaaagaaagtcttcacctggagtttctagaagagaactcttctaccttttgccacctgttccagcgcccagtgtgcagggagtgttaaagttgacaacttattggctcttgagatgccatgtgatatttcttttggggtaaaatttttctgaagttgtcatctacataagccttctttaggcttctatatcttataagctattatagtcaaaggagaaaccaagagttctgaactataaggagtgaaatgctcacaaattctcttgttaaacatggtaactacctggtaacaagctgaaagagaaaaacagtggaatgtggtggccagatattctgaaccaatgtctttcatcattctcagaatgttatgaaatttaataagtgttgattcaatccttattattagtaacccagctagtaattcaatttttttggtaagatgtacatcaactaaaacatacttgtaagtgccttttggctgtcagtcatagtgtgccatgggtgtgcattaattaaaatgagatagcaggcttgggatgctgacatgaagaaccctcttcaatggatcctgactaggcacagagatggttggggcaggggaggtgaatactcaatgtattggaaacaggacacaaattatgtcttatctcctgctcctctagtcaggtgaccaggaggaactggcattccagtaacttctcaatgcttagctctggtgttataggccctccataatgtatccttcgtctcaactctgtacgtgtgatttcccacagtattcaaaggtggaaaggcatcctgtgactgcattggagaaaatgatggagtcaagttttgtcggcccccagtcattccctgaggtcccttctcctgacagaggaagccagtctgtcaaacaccacaggtacaagtagctcatcatggtgggtgtgggcaccttcacactgtgtgtatgctgggtggcacatgccaaggactggcagcatgacttaggagagacaactgttcttgcttctcctgtagttctctgtggagtaaatgctcaaacacctcacatcaggtaaagcaaagataccagtttccacagcagacagcattgcctctgtaagaaacctgatagaactatagataacacccatcaaagttacagaccagtaaaaaaaaaaaatgcattctgaaaaactattttaaaaaatatgttatctagcctgccttttctagattacacagttaatgagtaattcttccctatgcagcctaatgtgacagacttcaggttttccaatatggttcttacaaaataaaattttccacggggaagaagcctggtgaatcttcttcttgggtctataaaatcttctgttataaatgaggtggcagtttcttgcaagcttcccagaaattggctgctttggagaaaaagccaaaaacatagttatttgacacatttcatagcattctaaagcttaacttgtccttcagcatcttctagtccacacttttctgttatcaggattctgaaactccaaatattaaaggtatttgttctaaaccaaatgatgaagtttatgactaatgctagattgtgttcagatatacatcctcaatctttatggaagttgtccgaagacttaagcttccttttcttagtgaaatgtacaatattttacaatttgaaaaaattatgaaaaattaaacattttaacaatgaaaaagtaaataacagttgttcccagcaatgaaagttgaatgttgttgcccctttgttttcacatgctgggcaatagtttgcacaacaccaagccagaaacatacatgatagaagaaaactactttctccttcaccttttaatgagttacatgaagaggattttattgtttctggccacacttactttgagatttttagtcactcttgacactaatcctcagcacttcatggtaatttttattctcattctacatgagtagagactagaacactgagagtttgccatttaaaagaatatggtatgagtctatgttcaattcaggattgaaatatgtttggctcttggataattgctttagctattcttactgcaagttttgatttatatcaatgttgcatttacagaatattttcctgtgaaaagagcatttcatttcactggacctaatggaagttttcttaattagggaaataagtccaatattaccagtcttttcgaagacagatattttctcccaaatggtattttctcctcctgattatgacacgttaaagtagtattccacctagtcaagtaattcagtataatatcattctagtattatatgaactgtattctgtcataaatgttttaaaattgatatatatgttttaaaacatcagctcttaatatgtttgagctgcaatattcctatccccagttctcgtgtgcttttatgctccctcctaaacttggcttctcctatggtgtctaggagtcactcacagattaaataaggacatctttaagagaccttcctttttgtttggatcaatgacattgcagtatctgttggcatacactgtgtcctgatagatgggcaagcgttgacttacaaaatgcttttagaactttgtaaattatagtttaatatatcatagcttttgttttgtaaaacatgcaatagacttgaacgttttcatgatcgataacccaggcactgatttatatatcctgcaaactgcaccataacttcctgaatgccactgagttagaaggcctgaatagctgattgatcaataggcataaaactctttttaagacaggtcactagttcatactgatatactttgttgttatgacagtttagcgaactatgaataattaatttcttttgtgcactgcaaatatgactcatttggataactcatatatgaaacagagctattaattcaaagccattatttctaatgtttagttcgaaaaaatcccatctgtttagaaaataaatctattacggcatgtcatatttattgcattatattttggcaatataagtcacttatctttttttattattttatttttttggagatagagtctcgctctgtcacccaggctggagtgcagtggtgtgatcttggctcactgcaacctccagctcctgagttcaagggattctcttgcctcagccgtctgagtagctgggactacaggcacatgctaccatgccgggctaatttttatatttttagtagagacggggtttcaccatgttggccaggctggtcttgaagtcctgacctcaggtgatccgcccgcctcagcctccgaaagtgctgggattacaggtgtgagccactgtgccccaccatgccacttataaaaagcatgtatgtaggttttttgcattgaaataattccagggttttcagtgacagagaggaccctttgaattgccagctgtggcaggggagatagaggaactcatcgtgctgagcacctattgtgtgccaggctccatgccccatgctttgcatacttcctctctttaaacctccacatcccatagtgaacctaggaaaattcttaagtagaatgctgatatcttccttttgtcactcccttctcactctagcagctagtttctaccttttttgttttctgccttgccctgtacaccaagagggctgcaggctcttatgtcctctggtttctgtgggttcagtgtaaggcacaggcatgagatagacggcagggaggacagtgaggtcatggcacttgtgtccccttcctccctgcttggttgccttccttatatcccttttctggggccatggagcctgcagtgcggccccctccttacaactcactttctctctgcattctgggaactgctccctctccttgtcccttaagtcagagggataataacagcttcccatagtagtcctggggcacagcagtctcatttattgctttttttgccctcgaacacttatcacacttttgtatatagcaaaatctctaacaatgaaccaggttaaagtgccatctatgtctctccaggactctgactggtacaagtacctccatcagcatcatgcttccagtaactagttacctgcagacctgagacttatactcagttgcagccaactctagcatccaaggcttcaggccccgcagaccccatcattgccattggatggtagataaaagtaggaaggcaaggaagcaaattagctgttagagagcttctccaacttgtgggcttagtgagctatctagacatcccttgttaggcatttggggacacaccatataatgaatgaaggtataggggctaggcacagtggctcaaacctgtaatcccagcactttgggaggcctaggtgggtggatcacctgaggtcaggagtttgagaccagcctggccaacatggtgaaacctcatctctactaaaaatacaaaaattagcctgccattgtggggggcacctgtagtcccagctacttgggaggctggggcaggcgaatcacttgaacctgggaggtagaggttgcagtgagccaagatcgtgccactgcacttcagcctgggtgactctgtctcaaaaaaaaaaaaaaaaaaaggaatgaaaggaatgaaggtataacaatgaatgttgccagatatgatctcctgcttgcacacatttaggaagttaatgttggcttgaggaatataaagtttgatcagtcaccgtgccacaaccaagaaagtggttactaacactcaaataccagattttcaaactctaaccttaaataatatttgtaaagtcctgttttgtattgactaagtagaattaacagtaatatttatggaagaaaagtgacataaccccaaataatatagtaatatgggtaaaatgtctttgagagactggtttctttagaaccttgataaatttattgaaattttgagaatgttttcatctttctttctatggttgtattgatatttacagagttaaatgagaatggagcacagaattctcagttcctttattatttgagcactgcagaaccagtgtgaccacataaactagcatctcgtggaatgtctacacatgagcaaagttctcctcaccagtctacagtagggtcaattcagtggggtggagatgggaatggatatggaacaggtaatgagtctcatcagcaatggatttttatagagtctagttcttttctgtgcataatctatgtaggaattctcagtttgttaaggcctgtggtataacccacttacatgttttgctcattgatggcatctataaacatatagttatttaggcatttggatgtatgagtcaaataaaatatataatcagatgtttattaaaagcaaactcagaagaaaaataatttagtttgtcaagattgattaaaatctgaggtcgtgaacagggaatttaacacatatgttaatgagaaaatgccaattaaaagttgttaattttatcgctaataagtgaattttttccccatatcccttctgggcttactgtgttcagtttttgtcagcgtctcataagaaggctatttttatttctattagagagacagctatgatggcttggataatcaggatggatgggaatgaggagcttgagaattccttaagttcacctcttaccttggctggaaagttgcaatgattttcatcagtcatgctctaacctagaaagccagaaatccaggaacttccctttttctcagtgtctccaaaggtaaaatggattgggctattcctgatctcattctaccacatatacttcattcagggatggccctggcctagaactttgagaatttggggtgcagattcagtgtttgcaaagcttgagcagccacctgtgaggttattgctatgatgtcttttgtttgtttgtttgtctgttttcattccaccccagcaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtaggtcttaaaacagcagtggaatttagggagggtgtctttaatgccatagctttaagttaagttttaagttccttggggttttattcattgatttattcattaactggctatatatgcttactgccatctttgttctacaaaaggtgaaccaactttgatgtatagttgtgatggaaaataggtatcagggaaacattagattagaaagaaatataactaggaagaaagtaagtgtagctctctaggcaatatgttattagatcatttgctaatacaactggaaatttgtctttgatttaaaaaatcaaaggaggattaaagtgttccttcatctgcagattagaaaaaggaccgaattctctgataagtattgtgaacaatacgctaaacaataactcatggcatacgtacagtatctgcttcccctgagcttgaatgtagaatttgggtcaatgttgagagtgtaaagtcaaagtacaacttactgaactcatatatgcaagttaggggtagacgggtgggctttggacaccattgctgctactctttacagtgcaaaaggtgtcccttcctctggtggacacagatccatagaggcctcaaagcatggtgagctgagtacaggatgaatgttaaccattatccatgtagttggcataaactgcccaactaaacatgcgatccttgcttaaactgactggaattcaaatcccatctctgctccttactactagtgtgactgtgataatattttatgatgtggtcttagatgctcttatctataaattgagaaaaatagaccagacgcactgcctcacacccatagtcccagcactttgggaggctgaggcatgcagatcacttgagctcaggagtttgagaccagcctgggcaacatggcaaaaccccatctctaacaaaaatacaaaaaattagctgggcatggtagtgtgtgcctgtggtcccagctgcttgggaggctgaggtggcaggatcctttgagcctcagaggtggaggctatactgagtgcacatggtgctactggactccaacctgggtgacagagtgagaccctatctcaaaaaagaaaaaaaaaaatacaaataattgagtaaaataatatcaaccccctgaagattgttgggcagatttttaaaaattatgtgtgtaaagagtttgtagtagacacacagtaagcagagaagtggtactggtatttattgtcacagtaattgttataattttttcagcaatttcaagtgcaatgcaatcagggtttactctagaaatttcagaaatcacttccctcactcaagccaggttcttgtggctctgtttttatctctctgaacgagccaagccaggtttctatgctgctttggcctggatgatttttccagactgtctctatcaggctaaagatcaaaacgggttacgtctagcacagagcctcacgtttctcttttcatatgggcatgggatatatggagcagtgtcctgtctaacaaagatcagcaacagatttcttaaggaaaactggaagataggaaataaatggccggtggctaggttttataattttgaagcaattccaaatggactgtaaaaggcatttggtacagatttagggtgacagttgcaaagtaaacataacagccaaggggttcaaaatgtataatgcgagtcaagaagcagtttgcatttctcttggtcttatctgtggaaaagcaggcttgcatttaacccataattataattgatcatgtttcatagtgccttttccatataaataactaatgatgcctcttattagtgaatatgactatatacatatacataaactccctgggatgaatgttacaagaacaagtgagggaaaatcaacttcagagattttgtgagtggacaaaaaacccagctcatgctggccttttttttctattgggcactgttatgaccatctttccatatgttcgattagtaagggtgcttggagcctgtgccaggctcaagcttgaacaatgcacatatcatcaggggctcagagatctcattacatgttcaggcaatgctttgcttttttaacctcctgggagactcacttattttctgcgtggtggtggttttgttttggttcagtcactgttgggttggaatattctctccagttgcctggccacaggtattttcccatgtgtgatatccaccagatgttgataaatggtgactctaaatataagtcactgtatacccagcacaatgaatctcagggagcaatctcattctcagttcttaaaaacagccattttccactccctggggactgactgtctctctggactggaaatgggattcgtaatagaatttcacagctaaaggccgtctttaaatctggccccagcctggaggagggggaaatgaatttgcaagagccatcagccatctgctccttgtttaccaagcaagtgggcgctgtctatgacagttaggcttccaacgtatgtggcttctttccttggcaagaacttcagcccagcttgaacctaacatcgatcttattgtagcctggggaaggagtgaggtggagaggagattcttgaggaaactttgtcatgactggatccctggtcaatgacagccatggtaatggctcacagaatttgaactgtatcatgtcaggaaaatcaagctaatgtattcatatgccagacaaaaagagatggaatcacaaaagttagattcacaccttaaaagcagataaaattcaaaatgtactgaatacctaccacacctagctagcaactttatatacttctcttcagttattctttagaaattttattgataagcacattaaggatatcagagtttaaatggctagcccaaagtgacatacacagtcctgtgtaaaagagctgcgattgaatactggcttttctgactaaataaaccactaaatcaacaaggaatgtgaagaaaaatcacatttatggctgatgatttgtaaacggaatatctaattttatggcttcagagggaagcgtggatgccttcaaaatagtctgttcattcattttcatgtgccctaggaactgagatggtttggagtcgcctagagaaacacaaattccttagcctgactcatgaatgactgggaaccaaaccaagtgactaatagttggaatctttcttctttaaaagaatgcttcgactcacatagttacagacaagatgcatttgtaatttctttgttgaggatgagaggaagactggcccaaagtgaaatgataagctcatggaccgaacttgtggaagcatcattggccctcaagagatacagaactttgaatcctctgactcagaatcacatctagaaatttagctctcacttaaacttctgctggaataccagtggtgagacactcacatcatgtctggggggaagtgaggcttgccactgtgtctctggtagaacagggcagagacattatttcaattagtcctcagaaaaatttcccctccctctgagcaatcaagttagtgttactacctgattgttttaattgatggcaaaattaaagtgaggctgccatttgtctgagattccagagcatatagtaattttggaacttgaaatcatgtctaattcaaaacaaaatcacagttaggaaagttctcattgtttacagctcatcttcatgtcatggtaacattttaaatttcagttgttaccagtcatgtgttcaaagcctgacttgggaattgacatctaatagtccactgcaattcctctttctcatctaaatcctttagtcagtcctctggcatatgagaagaaccctcaaagtttggcgtgaattgcctttgattatgtcttagtcatgccacatagttgacttgttgaatttatattctctaagatatttgcacctttttccaactgtttagacccaagtgtaagaatttttacctgtcaccatcacatatcaacttaccagattctacctgctggtataccctgatgatatttgtgggaaatgctatcctggctacattttttgtctctgtttcactggtgaacctgacaggcagactttctatattttcatacatacaaatcatgctaacaagatggtgctgagagcgaaacaaaagcctgaaattttttctttacttcttgttgaaattgatttattgattagaacttttaggctcatatttttagctcatatattttaggctcatatttctcatataacactaatgagaatggagtaatattccccaagaatttccaaatatgtagctgtgcagtttgtatgaataaagattacataaccccaaaaagcttttctggttccccttaggatagtcgttcattagcaacctctaacattgatagtaattagaataagacaacttgggtttaaattctctgtgtgacacatactaaagatataattttgggaaagtcatttgagtacctcttagtctattttacgcacccattaaatgataataataaataaactacaaggttttttaaaaataaaatgagttaattggagttgaaagtgatttttacaagcactgtacagatgttagctgttgttattaagtctgaaaatagacattaagtaggatataaagggagagtttaccttgaagatttgtttatgtattcatgtgttcactcagttcaagtgtattgattacaaactctgtattaggcacagtaagagaggatgagcctacaaaggcctaaatctcttccctgtttgtgttcactgtctggtggaaagacctctaatttgctcccatcatgtccttacaataaagatttgtatttagtgtgcaacacactgcattgcaattattatctacatgtataaacatgattttcatttacataataatggcagtcgaggaaaggagatttattgtatggaaggttgatatgtttaaattgtgtcaaaatttgaatgtttactgtttaaattagggacaaataactaagaaatagaataaaacactactgttcaagttccaaaaccccatttctataaatctgctgcgtacctgtcccattttctgtcatggaacagcacagaggagacagatttactagccctgcacaggcaagaagggaacttagaagattctgctatattcaaatgacttgtgatggcatattggcattcttgacaagcccttgccatggaccaaagaactaccttacttggtttcttggttacttggttgtaaggaaagatgctagatgggtagaagccctgtggaacccacttcatattcatccccaggcaggtagaggaattgttagcctcccattcccaccggctggctcagcaatctggcagtgaggtggttcctttagagcacagtgccagtggaaattggatttggatcccctaaaatcagtgtgaagcagaaaaactcttgattgtagtacctggatgcttaatattgggcttcttgattggcttcgactagggtggccacaacaagtctactggactaacccagggctgagagggtggtcgagttgatggagtggactaatgccattatgggtgtcctgtttgtcacaatggaaaggccacacttacctgctcaatccccatttactttgtattctaggatagaggtcaggaagactatatcccacctgcctatacagctgtggtgtgttgaaagacccctggacttaaagtaagaagatctgggtttgagtctcagtctgtcacttattttctgtgtgaccttgggcaagtcacttcacctatctgagcttcagtttacttctctgtttaactgggaacctattatccgtctcatggggttgctgtgagaattcagtgagatggtgcatgtgaaaagtgctttgtggattgagtattgctctaacaaagcctggtagaaagcagaaggagtaacactgtgtttctttttcaggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagcat

SEQ ID NO: 481 - DNA, 1111867 bp, Homo sapiens; identical to SEQ ID NO: 480

SEQ ID NO: 482 - DNA, 1109494 bp, Homo sapiens
acaggaaggagggaaggaaggaatctgccacaaaccagaatggcagtagagccagtaacttgctgcttctctctcctttggctgaagcagtcatttttgagagcacattttcccaggaggtgtttagagcctccactcaacaaatctagcttgtgttttgtagaaggataaaggattcatgagtgtatgtgtgaacatattcaatggattgaaaatgagtctaccctgaagaccccagatttttgatctgctcttttgatgcagttgatagaataatggagtgtggtatacctccaacccttgtatgcgttgggagaggagggggactacacacggtaggggtatttcatgttctttctcaattgatttccttgtgtaccattccggaggtctttaaagaaaagcccaaggtaattatttctacccctctatgctctcttcctacattccgtggacgggaatggcagcctgtttaataagtaatgattattgacagggccctcagccccaaggaaaagaggggaaaaatctgtaaatggtgtcaatgttcacatagacatataagcagtatttgttgtatttgtatcttagtttcagctctttctcttttttaaacctttacaagaagttgaattaaggtatgtaatacaagtatgcaaaatccagctgaaattgacctggtttgcatctataaacaagggaaattttaaggaaaagtggattatgtagttttcataaaacgtgtttaaataggcaagttgtatggtgacttgaagaaagaggatagtttagttatttttttcatccaagattgcaggatgattaacaaaaggaaattaagatttcatttgagagattatcagcagtgctactgtaggatgaaaaaagcctgaatcactggtgttcatattttttttacttgtcttgattatgcccgtaaagttcccaggagagaaattttcttttccccagctcctacctccatactttagtgggtctttccgtcctttcttttttttaaatgaaagtaatggattctgttgtagtacttgaaaaaaggttaaggatgatgctttcgttttttgactaacccacaaattctttaatggccaggatctttgctcttgcattggatacctgaaggcttatggaatgaatgtctttgtgttcatcttagatcaatcagaaggatcctgtctgtaaggatcctgtctctttggagtggaagaggctggttcactgacaatgaacatgcttgctaatggataataggattttttcaagcaaaagctgtttttgctatgggaaaggcccagttagagaactgtttctaattttctgtaggaataaagacaaagaaggattgaactttaaaggcaggaggagaaaggagggtttgcaagttgattcttctcttcccgtcctccaccgtttaggccgtgagctggaccaaaactttcttcagcgttcctgggattcttgggtttccacttgcctagtacttgcttgcacttcagactctaaaaacgaatgtcttaaacatatcgccaggggagattatttcaccagaaacatctttgaagcattttgtatttgaaagtagaggttaatttacaagtttttcaagccaaagggaggaggtcactacagacagtagaaaacagtgattttgaccaatgtacaatcagcctttcccttttacagcgccttcaatttcgttttcagatttgaaatatagttgtacaatgctgccaatgcaaatgtggattgttttagagacatagaattcttttactaagctgaaaatactgtttaacaggtggtagcccggagtcattggctaaattcaaatactaaagacaaagagcctctttttataggtgtttctttgggttagatttggaaggtatatggttaattataatgaacatcacaaatatctaatagtgtatttaagaagaaataaatgtagaatgtacatttgatgtttaagcaaggtatggaggcaattttaatttaatcatgtctatttctataaaactttacctagtcatacctactgtaatttttaagagaggcattgataaaatcaagtattttcttatttattcttttcaacatcttcattccttaaataagggtacacttgtttgctttataagcagcctcagatataatttgtttaaataaagttacttctgtacattgtattctctctacatgagtcgaggcctttaaaggcatccaacgtagaaggtactgaccccaatcatgcatggtagccaaagtgagaggattcagagctcaggatcaatatttcttatgaaatccaattgagagcttttttttatgagcacaggctgcaacctgagtatgttttgatttcctttggccttaattcaggattatgagacttttctgctttaatcaattatgctgtacaattttactgttacacacttatgttgcacttcatggtcctaattaaaaaaagagggcaggggtgggtgtgttggcaaggatatttttagggccctttttagtttggactcgttggtctccgtgcattaagacaatgcggtttaagcattcctccccagttcttcagactgaagtgagggataggaggtgttgttaattgagagtcccttctgcaggattaatttgtgaatccagctacagttatatttgtgctattttcaaaacctgaccaaaaaaaacaaaaaaaaacccagctggtttctggcaatttctcgctgttactgaagcttttctaaattcaggttgggcaacaacaggagtgttggtgcagtttgaaatcagtgccttcctgggagatccaggatgtagaggaataccatctctcctctctctggagctactttctcagcccttcctcccctttgtacacaatgagaagaaagcttattttcaacttgcttttgtagaaattctttcctcataacctctcatctccaatgccaaacatatctcaatattctatctgggatgtcaaaaatggaacatgaaagttggccctgaagtatataagagcaagggaatagtcataaatctaagtctgtaaaatgcatttgaattgcttctgaatagaactgaaattcatttttctttctttctagctgtttttatctttagactcgtgtgttgggtaaggacagagctggtactgcgttgacaaatacattttgagatcctagaaattttacttatccacccaagaaagtgttccctccagaaccatatacataatgaagtgagcaatggactctatttgaaactttgcaatatcacaatcaaaacttacctacataaatgtttcctcttcatgcaattataaataaaatcattagacacatgtttagtttggttttccatttcactcttcccctaagacttcctgtactcccacctgccagtattttatagttgaatcatggctctgactgaaggctcctttcaggcttttgtgttttttttgtgttttttttttttgtttttttgcccttttttccttagcctagagtacaaggagtcaatactcattaaatgaaatttcttagatatgcttaacgtcttgcttcaagttgttttataagttaatcttttgggtaagttagagtgcttaagttgatgtagaaagttaaggaaaaaaatactcctttagggaactgagttattaaactgtcttggtgatttaaaacaataattaaggattcttaaaacctgatggaagctaatggtcatttcttttcccccatagattggtatacaaatcatattaattttggtagcatttttatctgattccacaacacagttgagcaattgaacataagctatcatatacattcatataattatattttcataatatatgtcacatgtttcaaatgtttactaagtatctatctgggggcattgcaatgctgttaagtaattggttgactccgaaagtttgtaaaagtaatggttcataaagcagacaattaaaataaaacttttaatcactacaacattcagcctcccatgtcttgatgttagggcgaaggctttttctaagtatgtgtctactggtttaagcttagcatctttgcttttcttttttttttaattagccacacctgtaactatcagctttttttttcttttaaaagacactagcgaaggaatccgtatgcagattctttataaatacaataataaacccttgccctgggaatctcttgcagttttcttgtctatatgattcagtttctttttttatgctttaaaaaacaacttaccttttggagtttcttcaaagcattcaactacattttaatagaaactacaattatctttcatttccataatcatatatcactggtttacataatatttaagtaaattacataattagcataagaacaactgacgtaaacaaatctattatcccaactgagtactgtaaagtgcacaactcagctggcagttgcagcagagtgtaggtttccttgagcttggcctggtggctgtgtccctttcactgtgcagtgggcctctttggtgtgttcctgccaggcagtgtggtggcagccagttggctaagaggagttagattaaggaagtgattcctttaggaggtaacagtattagaaatgagagtcagtcataaccatattttttagggactctcatggaagggtaacaaatatatgtgtgtgtgtgtgtctgtgtatgatacatatatatatttataaacaatatttgtttgtatatttctatataaaacctctagccgtgaattctataatagctgtgcaacctttaggaactgatacaatctctctgaagtttaacttcctcccctggtataatgaggttgatgacaataacctgacttctatgccaatcccgaaagagtttataagctgaaaaacaatcactgtttttatgtcaagtgaaatgggaagtagatagactggttattttcatccaagagcacatcagactattgaattcggttgaaatattggagctggtttgttacctagcttgagggatctttcatcacaatgaaagattattgttcttatatgcccttgggtttttcttatattcctctctgatatcctggcacacacaataaaatatagtgtggagtcctacctcaaatcaccttggaagttgaaccacaaactggaggtcatcatttctcattctttgcttggaaggtgttttttaaagcctatttccagcatatgtttatcaaagagaggagctgaaatttgggagaaaatgagtgagattcctgaatgatctggaaatctgaaatctaaacattcttgataaagcaaaatatgtcctaggtgcccttttgtgccatccctacactaattgtcattgggtctttagattttggagagaatttgtgtgaaaataggcatgtctgcactgcattcccttggccacttagcagttactgtgaattagattctcaagaattaataggttgattgtatccatcaaggagctcttttaaagatactgtttggatttgtactttggggaactttaatattagcattttggaaatatatttcttcaaatctgtgtttgttggaaatctcatcctgaattatatcttaaagtattactttttgttgttataagcttttatttctcaagacaggttggtgattgtacataaatcatagattgccattcctgggcctaaaaagggatcagtcagaagcaaacctacaaactgaattcagaattaagtttaataatggaagtttagcagcttccagtgctaagattttgtctttgaggccttttcctggaagtgatagtgtgtatcatggatgcaatataggccatacgaacatttttttaaagaaaaggtcagctgaatccatgcaactactttagcattagtatgttacagccagggttatgggaatagaatttttatgctaaacgtttgataagaattcttaaatatatcagccttcctcctcagataccttcctatgactacatgcaacctctggcatgatttcctgtgaattgccagggagctagaaatccactaaaagagaaagccacaccctcatcatcatcagattttcttcatttttgtagcttgaattttacttttagtaatgtagaaggattagtcacagataatcagtcttggaaggggcttaagaatttaagtaataataaaaacgacagctgccatatgtggagggttaccgtgtgcctgggcatgtagcactgtacattcttcgtgttatttatttttgaaataaggattgaaaaacaatcatatctaggcctgcagcctaggtttgattatctcactgatagagttaatcaagctgggcttaggatatataatttgcctaggacttgcagaaattgtttggataatcaagaagactggaggagtgttttacaggtaatctctccccacctcagtcttacttacctaattcactgttatagtgtcactatatccatttgtacattgcttctgtcaagcacttcacacacagatagtggcatttgccactgtaaactccataaatagctcacctgcactgtacctgttctttgctctgatatggaggaatctaactagagaaattgcctgggttttctgtctaaggagaaattcagatgtttcggtaaaagataaagaatatgttgttctgaatgttgtcttcttgtttattttttaagttttgttgatatgtaattgatatgcaatgtgctctccatacacatccttgggttctgcatctgtggatttaagcaaccagggatcaaaaatatatttaaaaataaaaacaacaacacaacaattaaaaatacaaataagaaacaagtatagtataacaactatttacatagcatttacactgcttgtaagttctctagtgatgactgaaactatatgggaggctatccttaggttatatgcaaataccaggccattttatgtaaaagacatgggcatcctaggattttgatatcctgggggagaggaatcctggaactattcccccctggaataccaaaggatgactgtacaaaaaattgtacatatttaatgtgtacatatcgatgagtttggacatgcatatacctattaatgctgtcaccacagtcagggtactaaacatatccatcacctccaaaaatttccttgtgttctcttgtggttttaattttgtttaggtagaacatttaacatgaaatctatcttcttttttaagtatgcagtattatattgttaactaagtactatgttgtacaacggatctctagaacttattcctcttgcataactaaatctttgtacccattgagcaacagttccctacctctaaacttctgttccttgatctttttaactctctattttctcttatggctgcttgtaggtgattcaatgtaacaatgacagaaaacagttacagactttattcctctgcttcctaaaatccagtcaaaattgccttctctgcccattccaagcttacttttggttacaatagtgactgcagtgtatgctgagactgatcaatggaaaagtgtcagggaacatttggaatgatagccttttagttctgtagacactaaagtactgactctaccaaatcaatgatgggagttggagctgcatgcaatgcctgctgcagaacatctgaattccatcttggagccacactgcgaagtacccatcactgattatctaccagttctaagaaggggaacattggtgagaccttgatattctgccgggggtactacaaactagacccaatcattgcttacttgcttgacatttttgtttgccaagtgttcttttagctagaagaaaaaaattctcttttggttaaagtaaaagatagttgagattgttacttttacaaacttataaaaataaaatggaaatagatcaagttctaagatcacgtgacactcatttgaatagccatgctgaaggataggaatactgtagtgtcagaaagattgtattgtcaacatcctgtaagactgtaaatgaatcccataaactaacaatgacagttgtgctcattgttagtctatgaggggggccactggggttgtttgcccaaatttattgttagaccaaagcttttttcagcatggtggaaaaatctagagacaccagaattttttaaaaaatgggctgtagaaatgtttatattaaatgatagcttgactgaattctatttcattgacttttcagtatgatactctctgtttctggattaaaaaactaacacatttcgggtgtgggggaggtagagcatcaggataaatagctaatgcacgcggggcttaatacataggtgatgggttgataggtgcagcaaaccaccatggcacacgtttacctatgtaacaaatctgtacgtcctgcacatgtatcccagaacttaaataaaattaaaaaacaaaaacaaaaacttctgacaaatgcccactccatgccgagcaggtacagttggtagcacttctgtcttaaccaaatgaaagctgccttggttaacaggtattagttatattagctcccaaacctgtttatgctgattgtttttgttactgtaattgggtaatgcatttaagtattctataaatctgtgaattgtggtttctattaaaacgaagttcattacattggatataatccataaacataagtcactttaaaaaaagtgcttcttctacttgacaaagttgtgagaagtttaacgagaatatatttatatatccataagaaatttgcacttgtattgtttcacatgttaagattttattccacaataaactaaactggaaaaatcacattatacattatgggtatggtttttcataagaaggacaacagatgtttactcagagaaaagccttgagctctataaccaaatatttggcaagtgaatgtgcatttgtatgttttaagttaaaataataagtaaaataaattttgtttacccatgtgatagatattacaaagctattaaattttgttgtactaattttaaagctttcgggaaatgtttggtatataatttttatctaaaactttgggtagaaaattatataagatatccatgatattaagctttactggtcactagatttaatatatagtaactgtattcaaaggaagtataccaaattgttcatggtagttctttctggattttggaatagggatgctgtttaatttattgtacttttttgtattatctaagttttagttattgttcatgaattatctttttttctaattagaagttgttatacttttgaaaaatgtaaagaatatactccatgaatcagttcaattattggtcttggttctgtgaagattgttttttctttatgtctaaagagtttgtttcttaattggtggtgtcagcattaaaatgttgatggagttgggttgctgctgtgaaatgcagatgtgtagaagtgcaaatgcatttccatttgctcatgggaaataatgccttattgaaggcagagtttcttactctgggcctttgatgattagccttgactttataagggtatagaagatgggagtttaatgagatacttaatggctcttccagtctgcagatgttagacagtcttagtagtattgctatacaaggatatagccaacagaaatcaataagttatatacacatattaatcaactatctgatctattccaaggatcaaatgaaaagagaacacaaaggctaattgacagtgctgagtactagaaaggagatgtttggtcaaacatgaatgggtgggataaccagttcaaaggtttactggatgctataagcctctcccagaatcataagatatttattcttatattaattttcagtggctggaacatagacagactccagagtccataggagagtggtgatttgtagggcacatgacccataagtttggtgatgagttgtgctcaaagtccttcaaatagttcacaaatgcaatgttggtccaaaagagccagaacaaatatatgattctatttatatactgtgtaacaattagaagtcaagatggtgattatctttggggaggaggggcaggtagtgaatggaaggggacccaggtgtaggttttcctgtattgataatattgtgctgcttgatatgggtgctggttacatgagtgagttcacttcatcaaaatttagtaacttctatacttttgatttgtgcactttttgtatacatcaatactaacttgaaaaaataagagaaaacttcaggaacattcctttggcctttaccacttcatgcaaccagggtggtggcctgagtttataggtttttccatgtacagagactggatggtagctctgaaagtttgttgttggtgtctcacagtccagcagatgcaaagagggtcttcctggcttcagcattttcctttgttctcaggatcccctcttagtgagacttcatgcaaacacccacattcccttttgacgtaagcctttctgagtggacaccttgtatttatattcaataaaaccctatttcactcatatcaggagtgttcctgatataacacattgcgacacttttcacatatcttaacacatgtaaaaccccacttgtatcctgagaatggcattattacagttctgcaaacattaaagtgtgatatacacaagaaagataattcatcatctgcatctgtggtttttgttgagaagatcagaagatatgcaccaaagaatcattaagtgctgaaatgtgtgattccaaatgaaaagcatatgaggccatttcagaaagtagtgcttagagggagaaaggtagtttcaagggagaatttccttaggcagagtaatagagaagggaggcccagggagggaaaggtcattaataaaggtagaagtttgcatgtacccacctatatgggagccagtgagggttctgacctggtagacagacggcctcaccttttccttggagcagcgcctgattaaggagggagggttttggaggacacagcttgattctatgttaagccacagtcagaatgggttgcaaggaagtgatacaatatctgtggtattttcagaaggtgcgaggtttccaggatgacttggagagaggaatgagcagcgaattttaaagattctctaaggctaacttgttccaaatcatttaaagatattgtctctgatttgtgctggatatatttaagtattgacttcattccaatgcctcttcaaagcgctgcaagaagcaatagaattggcatgttttaaggatgtttagtttatccatagtcgcatcaacaaagccctagatttaacccaaaataacagctttcaaatacctaaaaatttgcaagtagagatacaagaagaataacaagaaggaactcttgatttcactgcctcacctaaattaacctcttactgtctttaggtttttcagaggcaaaaactcctttatgaattgattgccacatcacccttctggttccatctgaggtcttctttgcagaagccactcagcaccttttggaattgaatgctgacatcgcatcagattcaaaaggaatgctgctgttgattcctttctgtactcatcacatggtgaggaatatgctgggagtctgtataagatgaggctcttgcacggcctgccagagagtgcctgtcatggactggagaactgcatccgttcatttacatatcggcagctaaaattagtggagtcacccacgtttttcaccctaaagaagaaccttcagataagaatccagttcatcactctcgcctgctcaggcttacttggttgctccttgttaccagacagaggggctatagcgctgtgtaagagcaaatgttaaattagtattaatagccaatggcatctctcttctatttttcactgatcaggtaattttcactgatgtcaacatttataatacatcagctgacatatacaagtgttatttgcttggaatatttttagtttatctattttattgacttagataaagatatattttttaaagttatttgttcaggtctttttgtatttgatcagaagaggtttttgaaaggaaggcgaagctgtagatcagggttttaacaaaatgagcatcaaatccaaatctgtgtttctccttcatcactgagttttgtaagcttctaaatgaccttttgtggtaccacactgatgctcatcttgcattgtgagaggctctgagtaatttatgataaataatgaaatgctgtttcctccaatacactgcaaatggctgagtcttgtaaaagtctaaggagctctattacttctaaatgactagataacacaaaaatgttaaccctaaagagaaaaggtcaagtagaccacgtgcttgtgagccacagtccttctgcctggtgccttctgacaggctttctgcatctgaactctgcagggactggcacctgaaacattactttctagaatggcaaggaagggtttaagcctttcggctacttggattggctagaagcaatagtggtttgtttggagtggggaagggagaaacttgccgaatccatttaacatttgaaaccctaaattaatttttaaaaaaaatctgttaccagtggtaagaattttgtgatgctaggaaacaacaatttaagtattttatttgagcactgatataaaaagaaatattaaaaagcaagcagagtaatgttaatctgtaggaaactatagaaagctgacatcttttcaaaattaacctttgccatgatgtttgcactctcttgctcatatccacgtatacaaaaataaatacatagtgaacatattcagtctacaactctcagctccctggtattccacagtgtattcctaccattggaaaatactgtccacagtgaatatgtgtgttctcatcctgattgctgtaaaataactgcatatctaagtgttagggtttgaagactttaattgctagctacagagtgtctttatgtattgcacttccattttgaaaattgaattaaattgccggtcagtgaactctttataatgacaggagagtgtctatgcaagcaagccattgagcagagtgatctttggccagtgatacttttaaactcagacactttgctgaagtttgccactgaattttctcacatttccccagatgttattacattgccaaatgaaatcatctgttccccctagtagaactgcctcctttcctccagatatcagctacaaggtatgaaatgaattgcataaaaataaatcacacatgctgcattttgggaagagtactcttgctgatccattaatttcttttcactgctgagttgggaagtccactttaatcttcaattatcagtaacgtgcaattggatgaacctcttgacctttccaaaatagagatgctttcatgccaggaaatttgagctctttgaacatttgagaatatttttgcttttgatgaaaaaggtttgttgtcatgtgccgtgggagaaagagattgaaagaaggaaggttattcccaaaggcctgtttgatgattggactatatggctctattcctgaccatgtactctctgtaaggtttggcatggacagcaatgtgctgttggcaatatggcgcactttaaggtatttaagcatggactcaggagtttgtagattatccaggcttgttacctcatctccatatgcctagtctaccacttccacttagatgctctgccatgttgcaaactgaacagaagaccctgatgaacacaaggaagatgagggaggtgatttccatggagactgtggagaggctggagggtcttgtcttagggaagtttatcattcctttgcgcaatcttggtatttgtgacgtttcttttcttctttgcttctgtggaaagttggaaataagataattgggatagtggtttttgaaagggggaaaagtaattaagacacagtgggatgcccctgcctagtttgggaatgcaggctcagctctgctcctcaattgtttgagaccccagggtaaactacttgatctctagaatttcaggctcttctgtaaatgaggctgttggacaagatgtggcaaagattccaggaggccagggttttaaatttgagattagaatcttagtggaattttttgaattatggtttctctggctcgctctctccctacctcccttcctctgtctcgctctgtccacacacatataaacacacacagatgaagattttgtttttgtttggttagtgtattttatgttggacatttgtcagtttggcatttaataatatccatgtttcaatgtgatacatacgtgggacttggttaagtcctaaagtcagatgaactttgcttgtttacaactttaaaaaagaattccatccccttcttctgggagatgtagagcttggtagccagctataggtgtgctattgccaagtgtgtgtgtctctttgtgtgtgtatgtctgtgcattatacacacactttatgtaaatatatacatatatgtaggggtatatatatatacatattccaaaaatatatatatacatattccaaaaataagggtatgaggagccctggaggaattgcgggcacacacaaaatattttatttgaaagtataaataaattcatccaattctagatatgatatctcacccccttaagtaaatggaactcttacttgctgaattttacaaagagtgttacaagaagaacagagggctaaaaaatggtattcctagggccctattgtaaatatacctcaacgaaaggcaatatttcctgttacgttggttggcaaggggattttgatatcagaatgtggctccatctttcacattagaacatagctgtacgtggagatagagagtagatgaatggttgccagagactgagaagggtagtgaggggttacaggagaggtagggatggttgatgggtacacaaaaatagaaagaacgagtaagagctagtatttactagcataacagggtgactgtagtcaaaaataagttaatcgtacatttaaaaataactaaaagaatataattgggttgttggtaacacaaaggataaatgcttgaggtgatggatactccatttaccctgctgtgattatgactcattccatgactgtatcaaattatctcatgtaatccataaatatatgcacctactctgtagcaacaaaaattaaaaattaaaagaacacagctctgagctgcgacagtcagtgacatttaattcaaactcaaagtggctagtttatcatttttttccacttgcttttcttattattaaacagaggattttcactataggaaattagaaaatataagtaataaacggaaagtaaaagtcaagtgtagttctaccacccagagataattactcttctctttctgttcaatattagtccagtttttttgctttaggaatatgtatttgcaaaatgaagttgtactctaacacaattttagctaggtttttgcacttcatgttacaatatttttctgtcaaaacacctataaccctatatttaatggttctgtgatgatgtatatttacatattaaaacataatgagtgtatctcttcttgagaatttattttgcttcgagttcgtcattattatataaaattatgccctgaacatccgcagtatggaatggactttttttttgctaatacatatgcaaaaaagcttacttttttaaatgtgaaatttctaaattcacatccaggatgactgagcagttcatatacttgttgattagtgtcaaaatgctgatcctcccgtaaatcccctgatcgtcgtaggtgtttgcatttcattagcagcaaaacaaattaacaaaatttttgctagccatatagttttaaaagagtatcttcttggtttttatcttgcatttctctaattagaaatgagaaatcattagttagtaaatatcattagttaactactactgtggaaggcagagttcatggtggaggctagtgagcctgttctgtcttcatgggctgtgtgtcagatgcctctctgagggcttcaccgcaggcagtgatgtggtaaggcagagccaaggccttagaagttctaaaacttcccagtataatttagtaacaaaagatttttttcctgaaactcaagaacagtgttgtagatagagagtgggtcacatggagtccccaggtaacgtgtgaagctatctctatcagtcagctaaggctgctgtaacaaaatgccacagactgcatggactatgcatggaaatttattttctggctgggtgtcgtggctcaggcctgtaatcccagcagtttgggagaccgaggcaggcagatcacttgaggttaggagtttaagaccaacctgatcaacatggccaaatcccgtctccactaaaaatacaaaaattagctgggcatggtggtttgtgcctgtagtcccagctcctcatgagactgaggcaggagaatcgcttgaacccaggaggcagaggttgcagtgagccaagatcacaccactgcactccagcctggactctgtctcaaaaaaggaaagaaagaaagaaagaaaataatttatttttattttctaacatttctggagactggaagtccaagatcaagagtctgcagcagagtttgtttcttctgaggcctctctccttggcttgcagatggccaccttatcactgtatcctcacatggacccatcctaagagcttaattttaaattaatcaccaccaaatacagtcaccttttgaggcactagagtttacggcctcgacatatgaatggggggacacaattcagttcataataggagcagaaacacacgcactaatcaaacataaaataatttaaaacagtctagaggtcttaaattgtgcctctctctgagtgtagacagtgcatggagactgccctccccgctgctaccccacatcctgagcgttctgtcctcgtttccactgttctgctccattgtgtgggaggagctggagaagagactctgtttccaaggaagtgtggcctatgctgctctgcacctgggccttgcgacagccgctgcctccaaccaccacaagtctactgctgttcccactaataagtaccatggaaacccagtgcatgccaggggctgtggagaggtgggtgaacatcaaatcaccagtgacactggcttttcaaacgtcacatcataaaaatagagccacctgagtaagagcgggccacagcggcatcctgtagctccctgttttttggcatctacttcccttgggctcacagtcttctccatgaccagcaggaagactcagcactgcaactatctgcacgggttggtcgggctacacatgcctttccctagcatattgctaacactcaaaccagaaactgattaatttgatttgggttaaaaaatctgaccccatgaaggctttgctgatcattgacaaatctatccttcaagcattacagttttaagatagagggatgctgccttagtctctgccttttttgccattaaaaaaccttgaaaatgttatatcatagatagatacattctaataacagccccaaaactgatagatctgcatactcagattattgatcccaatactctcagcagttttaagccccgcccctgcccaaagggaacccctaccaatttaattcaggaggcttttggatttcatttaatgtggatgttatcttgttttgtttctcactatctgatgctattaccatcttaattaggttgaaaatcagcaattagaatcagaatgcctgtaatagttgtttttcttttgatcatagttatactcttaatgatgagattatgatgtgtgtgtgtccacgtgtgcatgtccatgcgtgggagtgtgtgttgtaggaagagcagtggatgttaagtcaggaagataagcttgaatgtgagttttgcttcttctaagatacctgaacttgctggagtgagcctccaggagccccagggtcctcattcgcaaaaagtgagggaatggctgttccttagattaggctgctttgaaatccatagatatcaaaccatcttataaaccaaggtgctgcacagattaataactgacacattggaagccgaggagtgtttagatatgtgggaactgggggcacattgaaatcattactagagggtaaatgttatttattctatgagctaattgcgggatttaaatttgggagctaaattttatcttaaatgttaaatattgtacgtaggaactggtctttggggggacaaattcaagctagtaaggactgttagagaggagaatgatgctgtgaaaatttaaatcccacaatgttgtttactagaaagatatccatttccaggcatctggacatgaatttctcagcctttgagaaaagccaacttaaccagcatgccctttcgatatgattgctccggaagcgtgggatgctcagtttgaaactgagttgtatgtcaatctctgatatctcaatttctgacacactgaacacaagcaggagaagagatgtacctctaaagagtgaagaactctctctctcactttctcgccatcctatctcgtgccatttctctttaggttgattgtttttaagaactggtgctcagtgcttagtaaagaatacttttctgaagcatttctcccaaagtgtatcttgatagattctgcaaactattaagtaagatttcatatgctgagatggtgtaaggtgatttatatttttggagaaagctaaaattcatcttactgacttttcaatctctccttattttcctcttttccatatagatatttagaaaagcaaagtatattagtagatttaatctccagaggatgagaatctagggctttttttttttttggttttctttaaagattgtatgataaaaaatgtttattatggcttaagggggaatgaaggtattcagataagttaattacatgaacaagcatgcctgattcctcttccacacagcctgtctcaagatccttcattcgtcaactatttcttaagcacctactacttgccagatgctgttttaggcacccagctccagagctgcaataatgatggagattttctcaaacccaacacccctggagcttacattcccgtggagaagttagataggaacaggtatacaagtaagataatttcagctattgagacatgctgaacagggttaggataaaaagtttgaatttatataggtgttcgggaggccacagctgaggtcatggtagttgaaatgagttcaaattagaagaagccagaaacggcaatacctgaaacagaagggtatcagaaagagaaaaatggaagttcaaggccctcgagggactgaaaaatggccagcgtgcctgagcataataaacatgctaaggagtggtaggaagtgaaatgggagaggtagaaaaggtcaggcacataaggaacttggacttgattttgttgtaatggaaaaccacagggacctaggtaggggaaggtgttgatatgctgtatgtttttaaaaagccactctggatgctgtgtggaactgcactcttgaaagctacacctggagacaagaagctaagtgagaaggccactgtgagatcctggcagcttagactagagagtggagacatagtaggaatgtgtcctggaaggtgggaaagaggacttagattgaaggaaaaacaggaatgaataaatcaagactccctcctaggttcccgtcctcaataagaggagggatgataccattattaactgggatctggagggtagagcaatgagttggattgggtggggggatggggcgagggataaaagagtggttttaagcatctggcattctccatgcttgttaggtgtgcaagtgaaccttttgagaaggtaattggatattgtgtggaagggagggaatagacatctattgaaagaacaaatgatatttaaaagggtggtggtgcagggaagtggatgtggagacccacatcagcactgaaaaccagtgatgggattatgcacaccatatagactgggaagtgacagggaaattcttgtagatgtagtgcagtggggatgttactatctctagtttttaatccagcgtgcatttttaatcacatgggggagatacaaaaataatatacccatgccccaggccccactgccccactgtagaccaatcagtctcttttttagagggaagggtaatggcaggcctcagtagtttttataaagttccccaggttattctaacatgtggccagggttgtgggcagctggattagaagaaaggaagggatggcctgctaatcctgttaggagggtggcccctggaactaggaagtggaagtacctcagtgcaacctcacactcattctttggagaagaaaaaggaagaaagtgagggggaagccaagtgtttgagcagtggagatgggaatcacaagacccctgccagcaagagcctttattcattcagcatggttgtcacatcaggggaagagcacattctggcccctaaagacgacaatggttgaagaaaaggtaaaggacaacttcccagatagctcctcagtgacagccacgtgctggaaattcttcagcctgaggtgaggctgtccctgcaactgtcagactcagatccctctcatctccagggttggctgaatctactatctgggcaaaattatgtgcagacaatctaaatgtttactctctatgacagtttgtcagtaatttttagtatgggacccagggttattaaaggcagggtgacatgggctgcagtatgacttgatgtaaaatatttcagcatgcattcttatctttgaccattaattccacttttaggcctttgtccaaaataaataaataatacgtgtttgaagagtttttttttttttgtacaagggagaaatacttgaaatatttgaaaagatttgctgacatgcattttctactgtgtaggcattgtaaatcatttctttaaaatcagagcatgagaaaacatataccatgtaaggtgaacttggaaaaacaggtttaaagttatgtataactgtggttatacaggaagatttcagaaaacaaacattggtaataaatacaccaaattgttaaaagcagctcttgctgagtgattggattatggtcaactttaattttcttaaatttttcatttacattttattttatctcattttaaatttccttaggttttcaggcagctcagatatcccacagttttagtaagaacacatattgaaatagtattttaaaagagattgattaataaggtcttaattttagatgagtttagttatgcatttttaaaactccgattctccaaatttggaataatggtttctgcctctcagagctgttacaagaattaaatgagataaccagtggggaaccatgctgtgcaatccctgatccatgttacaatttctttagtatttttgcactattgcctctgcttctaccaaggaactttatcccatggaagtgctacctttcacctaacattttgttagtttacgtgaaatagtcaacagatatgaagatagtttcattatttatgctgattgaaatgctgatcattggtgcaaaccggcatcccagcaggatgagctgtgattgggtgaaacatccatcatgattccatttctctttgccagtgactggcttggggttgggcattgtcctcacccaggagaggtaagggggaatgtgctggtggcagcagggaaggatttcatgtcctaattaaaagagagaaagctcctggagagtgtgtgtgttctgacctgtacttactctctttcaatgggaccttggtgcctggagctactgaagctgccctgggaccatgaagctacaggcctgaagatgaagggcctggcccctgttgactccgtggagctgccaaagcaactggaggctgtccacctttaggcatcttgttgagtaaacactcgggcgaagtctgtgggcctctgatagttgaatgtttgtcatacacagtcagcagcagtgcagttgacactacctgtggaagttgacatctggttcccaaaaacaaatagaaaggttggtgggaggagaatctgctgtgtgtttacatattttaaacatgtatggcaccctaggtttttctttctttttttttttttctttttattttgatggaattttgctcttgtcgcccaggctagaatctccgcctcccgtgtccaaatgattctccgcctcagcctcccaagtagctgggattgcaggcgcctgccaccatgcctggctaatttttttgtatttttagtagagatggggtttcaccatgttgtccaggctggtctccaacacctgacctcaggtgatccacccgccttggcctcccaaagtgtgggattacaggcatgagccaatgcgcctggccggtttttaacgcacacttcttataagtgcctagcgggattacaggcatgagccaatgcgcctggccggtttttaacgcacacttcttataagtgcctagctaacttggcaaaataatttcatttggtattcatacaaatttactactttaaattactccagaaattaagccaaatgaattttggagagtctgagaatcttaaacaaatacgttgtgaattacaagtttgcagaactccatatccagtgtcatgtcctgagatttagattcgcatatcagcaaggctactgctaatgacgctggggttttcaggtggacactgattgccacagtcactgaaaatttcatttagctgaattcctggaaaatgcttaagatatttacattttgataatatagaaatcaagagttaagctaatctaaaatttgtttgtatgttttataggtatgatttacccaattttgctgtcctgagaggaaatattacaaatgatagctaggtttcttagataattggagaaagtgctgtgtaaacatcaaaatattcagggcatttgttattatttatgcagaaatatagccaaaatactggcatattttcagttagcaatataatagtaataatagaaagtaaaacattttaaaagaggtttttctggaaattttttcctcaggatcacaaaaagtttttatttttcataagtatttcagtgatataatgagcacaagatacgttttgatgaaaagtaatgtttacatgaaaaaggaaatgcttattgatatttaaagacaattccctactctctctccttttccacatggtgaagtcgggagctccagatagaaatccaaagagagagaaagacaggggcagggaaggtacagtgtggaataatgtggactgtctcacatgacacttaagaggtcatgtgatgctagtgactttgctgatgtgtcaaggctagggctgagaggctgtgtccagcactgtcatctccactacctgaggcagaagcagaactgcagccggggcctccctgtgcttccagcactgaaagtaaagtgaacaagggttatgtggtcaacatgtgtgatttcttatagggaattttggttttgtattactaaaatacatagggtctggtgcaatgactcatacctataattccagtgcttttgggaggaaaaggcaggaggatgtcttgagtccaggagtttgaaactagcctaggcaacatagcgagatgccgtctctacaaaaatgaaaaaaatttgtctgagcgtggtggcatgctcctatagtccctattacttaggaggctgaggcgggaggattgcttgagcctaggagtttgaggctacagtgataccgattgcatcactgcattccagcctaggcaacagagcaagactccatctctaaaaaagaaaagtaaaataaaatacatagcttatgtatctgaaaaccttcaccattggatagtaaaaattcaatttattataagatcttaaacagaatccttgagaaacttaaatatagttaactctaaggttatgaggagagattgtgggacttggaggaaaggttagtctgtaccccaaatcacatgatttttatagaaagaacacaaaggatggttacctgtgggcacattctggaccacttacatgtttacttaacaacagttccagcagttctctagtgtgtgtatgtgtgtgcgtgtgagtgtgttcactttataagcaggtaacttcctgcctatataaggtaactttcacggatttcagacagtgtaattgtagttactgggtagaagaggtctttcatgaaatttgcaaggggatctctgcgtattttgtgagtttcctcattgttctctctataattaacctcacagggcagaggatagtttcttttcttatagatccatatcacaggcatgattctccagctgaattcctgagctcaagatttcctttctaaataaaggaaagggaaagaggattttctcgaggtaatggacaagagttgggaaaagtggttgcagatatgcttgatgctaaggaagccctggtgtatggactgttatgtgttccctcatcccctaaatttctgtgttaaaatcctaaccccatatgctggtattaggaggcaggggcctttgggatgtaattaggtcatgagggtggagccttcctgatgaaattgatgtccttagaagaagagagaggagagggcttgctttttcctttctctgctcttgggcatttgaggatacgggagcaggggatgtctgtaagccaggaaggtggccctcatgaaatagacctgccagggcctcgatcttggacttccctgcctatagaataatgagaaataaatgtgtgttgtttcagccgcctagttcatggtatatttgttatagcatcctgcactaagacacctggcttgcagagtgaggtgccttataagaaggtaggatacgtggtttacacacaggtagccacagggtgcagggtgcatctgtaagtcaagtggttacaacctctgcctctctaggattaaaatctttggcactggagcgaattttatgatccatcttcctgaaggaaaccaataaaaataatagtaaaattgacaactaactacactgtattgagcatttcctaagtacttgtcatgggttgtaaacaacatctcactcagttctcagtacagtttgatgggacaggtactattatctccatttcactgaaaaaaaaggaaacctgaagtgaacgataattaagtttcgggcccaagttctcccttcttatgatatgatggttaggttttgtaaccagggttatgatttaaaaatctctgttccatttccccccatgaactcttcacttatactctaaaatatctcaaaagatgcttgtactacatgtaatatggcatgcgaggaaatggattttttaaaaaattttttagagactcagaggccgggtgcttcaggctcatttttaccacctgacccgcgggtacacagcatgtaattgtatctcaaaatcatttccagatatgttggaaagagcaataggaccagctgtgtttctcataaaagattaggcacaagtcatgtatgaggtttttctctactctgacttgtgaaagtccaagcagtgggttaacatgataaaggaaaacaaaattaaataagctggtgtaagcataacacaactgacttccagaagggagataaatgttgcatagagacatcatatccagccaaattgttgcctctggtatttccatttggctaatagtgcttaatattggttgaaaaataaaagtatgccgagaactcgtatatcatatggtcagcattgcatggtttcgaacactccagtgaacccatctggagagtttcagccaccagggcctgacagcctcattagctgcctccacaaggccttgcccaagcaacagtacaaattgctgttgtttcagggcgatggtgcagagttaaagaaaacaaacatgttcaactgttttgtgttttccatgttaaaacctaaagatggaaacctaattattcagagattccagcagaacactgagccctcactctaaatttttacagcagttatcaatgtgcttaagaaatgtgaatcaggaaagtgagtcacatgctcaacatggtaaacatgtatatatccaccttcaagacttcagagtgtgtatatatatatatatatatatattttttttttttgtttgtttgtttgttttggagacgaagtttcactcttgtcacccaggctggagtgcaatgatgcgatctcagctccctgcaacctctgctgcctgggttcaagcaattctgctgtctcagcctccctagtagctgggattacaggcatgcaacaccatgcctggctaatttttgtatttttagtagaggtgggatttcaccatgttggctaggttggttttgaactcctgacctcaagtcatctgcccgcctcagcctcccaaactgctgggattataggtgtgagccaccatgcctggcccagagtatatcttaataaattattatcacaaatttgcatcctcatggaatctgagtttggaggaaatctgatgagctcccagtttaattatcatccctggtataaatctcttgactgttcccagacagaaagggttgcttagtctctgcttggactccttcaatgctaagatctccttagactttaccttttgattccagatggcgctaatcattgaattactgtctcattagtcaaattccaccttctacgcctgttcttaattctaccatctggggccaaaataaggagcctgtccatgttccagcagacttttaccaggtgaggacttcagtcgtattttcactgggccttttcatttctcagataaatcagcaatcttttgtttctatggcagggtttcatgttccctgcagcattctggttgttctccttaggagtacagttgtttatcccaaactcccaaaccgcctcctttgtaaagaactgtgatcattggcaagtaatctcctctcagcccatgtttcctcttctgtaaaatcaggatatcatggtacctgcctcagagggttgctgtgagaatgaaaagagatgcagtgagttgaaacacagtacccagcaagcagtaagtgctgaaaaaaataagagcttctcttaccaaagtatctcttaattcttaatcccagtactaaataccaggcgtccagaacaggaccatcctgaccctttcatgcagtctcctcctcctcccggcttcatataattcatgaatttagcatcatgctctgctatctaactgtatcaaaaaaggaaagggctttcatttggctggatccatggttcatgagtccacatttgccttaagtgatcactgtttccaatttttatacacttacaaaccactcttcgtttttttccttagttcatggattctgtcatcttccccttgtggaaaatcacaaccttcttcatgtcttcagagttttttggcagcttttcccactctccaggtttcccattcctctaggtttgtagaacgtgttctaacctgcaaagcctctggctacctggatatgttattttttggaccacagacctgagttacagggttgagttgggaagttctctattaccgggcatttttttctggccttcccacagaccatagaatcagagaggagttgaaaaacaatattttcttttatatcttttagtgtcgtttatatagccaaagcaggagacagaaaaacacccttgggcaattcaatagaacataacttgagagacctggacctctgattagtcttgtacttttgtcataatttttggttccttctggaagttaaggccgtttcctactctgtttttacaggccattactggcaatcagcatgcagtttaactgtgcccagtttttgtgttttcttcatgtcctttgaaaatcagccctcacactatggctagattgaatgcattctgtgcatgcattctattctgctctaccctggtattgtttgtgttttttgcataattggaatttgccttcttaagaggtttccaaatctcttgggccatctttattagaggaagcagcactgtacaaatgtaaatagactttaaatatttctttagccctacagtttataatgttgtttggtcatgtttctttttaaagacttcgggattagagtaatatgtcttaggggcaaggagactcttctaggtattctttgtcttagtgactttattaaaagggtaccttgttgtaatgtacttacctcacaaagtttttgtaagaatttaatggctgttgcaattaacacgtaactgggtgttacagaacacccagagtagtgccaggcatgtgttcatggagtgttggctactactgctgttcttatcatcatcatcatcatcatcatcatgttcattggaaacgaaaatttcagtttcaaagaaaaaaaacagaccctgctcttcaatacagtatgcagccaaatgttcgtttcccagatgctctcattttgtcctgaatcacaattgttatttcaatgaagagctcctccttcattcaattgctattgttgtgaatactattttaaatagagtgcttggagaaggcctttctaaggatgtagcatttgagaaatttctgagaaagccaagaaactatctgcagggcatgtaggtgagacggggaagagcatgggcagtgaccatgccatgggagtatgtttgtcctgtgcagaaacagcatggcgtccaatgtgacatagagtggagcgaagtgggctggcaagaatatgttgccacgtgaggtctgagaagtagccagggtggggttacaataagaactttgaatttattctgtgagagatgggaaaaaattagaaactgctgagcaggagtgtggttggcttgtgtagaaaatagacgagatggaggcaggagtggaagcaaggagaacgtttgcaaagttatcacagtggtcttggtgaaagatgctattagcatggcctggagtgggagcaaaggagcgggtgtgaggagttctgatttcaaagatattttgaagatagtgtagagcagtgagggtctagaggattagtcagagagagaaatcaagtagaactggagagttctttgtttatttgtttacctgtgcaaaccagctacttttggagagagaagtactagagtaggagaggtttggagtggggaagtcagtcctttgttaaatttgagatgcctgttagacttccagtaatatatgtgatcttaggaaaaatagcaccatttgaagacttttctagcttccatttgttacctgtgtcacacctgatctgtttctaggaggatgtcaattatttaggagaagaaaaccaccaactaaaaatttaaacaaaacaagtaatagacttggtttcaaaatcatgatctgcttcttttaagagttataggggacctgcatccactgcctaaatgaaaacacagtcccttccaaatatacatttgattaattagaagctcaaagctctgtttttactgctttaagagaaaaaaattatcaccacattatagtggcaatttctctgatggaaactgaaatagtggatgatgatgatgatgatggaaatttcagagtagcacacaccttattgagtgattacattttaaaatatatgtgtattcatttattcatataatcgtttttaatgagagcactctcttaattacattatgacactgacttggtaaaagagaaaaaagatctctactgaaactatccctaaaggagctgatgttatggaaactgagatttttaatatttttagctgagaatatttatattaactggataactgcgaagatcacctccttttgactataaatttggagctgggttgtacagaattatatttagctctgggaaactaatcttaacagtgcatgttttaaaatagtaaggcttctcagtttgtacaccaaaattacagactccttgatacccttcttccaaaattttcagaagttgggacttagaaaagtttcattttgatattagagatggtatcttacagcactctgatttgaaagctagtacaatgaggtgactctcaaagaacaaaaggaatcaatatgcctaattgtgtttattgctactttttcatctttgctagatgctttagaagacaaaggccctctttaatttgttgatgcttagatgcatgatgtaatcttcaacagactgatctgcgctctcataattccaaagtttcttcccgattgcttgataaaaatgcaaccttaggtatgttttggaagacctccaagttatttcaatgttatgcaggtatatagaattaatattattgatacacatcttagcagtagaaacattttcaattatgattagaaaacatctttcttaaatgtcatcatttgatatcaccagtgatatcatagtgaatatttaggcaattttatccctgggcctagtccacacacatttttctagtaaagttgactaagacattcatgagccaatacaatgagcctatgattggtaacagggtggggaatgtctatacctttcatatattgcatcccaatattctatagtaggtattgaaacatgccgtacccacttctgtgccaaggagttttgtagaggtgatgagtcaggaaatccaagttctgatctgattctgttagaagctgattcactggctttgtacaagttatttcaagtttccagagattggtttccccagccatatgattacggggttcaaatgattgaactttgatgtttcatgttaaaccacctttgttcctctctatgtgggaatgggaaaaagtggacacctcagtctcgaaatagaagtttggggatgaaaaaggagagaaactaagtttgtaaccacagaagtgggggtcagacagcatggtttgagcactttcatgaatgcatctggtgtcagctgctggcctctaaaactaagtcctagtgttcacctgagaaggagttatctgtgttctctttcccatactgttttaccagtaaagatgatgatgagagaggtggtggtgatggtgttgagagtgatggggttggtggaggtgatgggagttgtactagttttctaggactgttacaataaagtagcacaaaccaggtggcttaaaacaatagaagtgtattctctcataggacctgaggctacatgtttgaaatcaaggtgttgggatgtacctctccctctgaaggctctagggaataattctttcttgcttcttttagattctagtggttgctggcaatccttggcattccttggcttgtagatttatccctccaatctccacctccttcttcacatagtcttctcatttgtgcatctatgtttctatgttcaaatttctttcttttttaaaacacactggccattttgggtttaaggcccattctactccagtctgaccttattttcattgcatctgcaaaggccccattttcaaataagatcacattcacaggttctgggtggccatgaattcttggggggatgttgttcaacccagaacatgagtggtggtaatggagatgggatggtggtattaacgggtatggtagtctgtggtgagggtgttggtgatattgatggtagtgatgatgtgggggtatccaagggttccatctcacatgatatgtactcagttgtagcaaaaatacttattgtacattgatccaaaattggctgcaaacctgtgactggttcttggcacatgcatcactacagagtaacaacaacataaaaggcctattgatgatgtcttaagggctctttgagaagtaaggggaggcagaaagcagttgtatcctcatgacaccgaggcagatgtttccgtctttaggaaggaagacagcatttctctgtacaaagcactttcagtttttacagagcaataatatttaaatgtaagacattcaacttgtaatcaaaatgggaaatagataataagacctttaaaggaaatatgcgtgatgcttttgtagtccatgttcaggatcatcttcctcttatttcttataagaaattttacaaggtctgtcctcatgtcattcagtgggcctgaaattgtatctgtttttccccttgctctaaaagttatattgaaggaatgattttgcactattgcacactaaaaaagcccctactcagaaattttaaaaacatctaaactcatattcagatatagtggagtaaatgaataattgtttcagccagagggttttctcaattagcattttaaggtcaaaatttaccctagaatcctgtagaatcagtggctgtgagtcacctactctttcctttcacataatctatttcttgctgtccacctactaggcaccaagtgaaataataccctttttatgtttctcagctctagcttgcagagaagagtaaagagaaataactactcagggcaggaagatatttgcaagaaggtagcaaacccccaaatccctttgacggtgggaacatcaaactgagcccttgaagactagagttctgggtactcaataatgttcaaagtaaaaatacttcagcaaattggatcaacactaatttataaactaaattaaacaacatgcattaaatgtaatctatgggaagccacaaaatattttgctttgcatattttttaaccttagtgataacaattcttagaccaaaatagaaatctccagtgttgcctgtttgtcaaggaagccttcttcattatatttcaggtggaactaaggagcacaattattttgataaacttcttttttactttttcattttctagagatagtgtcttgatctcttatgcaggctggagtgcagtggcgcgatcatagctcactgtatcctcaaactcctgggctcaagtgacccttccacctatgtctgtctcctgagtagctgggactacagatgcatgccaccatgcccagctaatttttattttattttattttatagagaaagaatcttgcaatgttgcccaggcagatcttgaactcctagcctcaatcatcctcctacctcagcctcccaaagctttgtgattgcaggtatgagccactgtgccaggcctctttcttacaactttagaatttttccataagatttctcctgtaggtaaagccaggttattcagtggaacttatccttggaatatatgtaaatttgtgccagcagatttttttgtcttttttatttggttgccaatgttatgatagccatttctttctcatcagtttggttcatgctgaatgccttgtgttggtgaaccttactgctatgtctttattagcaaagcctcagaggtatttcggcatttggccaaatatttgcaaaatgtgccagttagtcaagtggagaattcatttatttttgggcaaataatgggtttttaaaatgggattttcaggtaaagtgctactacatagtgaaagcctgctatggtgcaaagcctgctatggtgcaaagcctaggagatcaccaagaaccagcccttcccttccctccatttcctgggaatcacagtgtcccaggaagctctcatctttcattagctattgactgagagagatttttgcagctgcaatggaaatgccctctcgacagtgtcacttgcttttggtttaagcccgaaaaaggtacagcaggtcaagtcccatttgctgctgtttgactggagtgtgggcttgtgtgtgtcttcaccctctagcacagacttgttttttttttttttttttttttttttgatgagactacaaggaagaacacttttccttcactgcatgtattttactgttattattgttgaaaccattccttccacctccaacctttccccgttaccacacacacacacacacaccccaaacccgaaaccaaccacaacagcaaaaaacccaaattatataaagggcaaaggtaatgcagttaatctctgaattactttggattcctaacaaagaaagaacctaaacaagaacagcatctgtttaaagtaaaagaatgttttcttacaaaaaatattgttattgcttattttagaattgccattatgcttctgaaacgtactatgagagtaataaatgttaattaccagagattagaaagtgcaggcaaggagaaagataaaaaaagtctccaaaattatactcaccagaaaaaaacaatcaccgttagaaatctcagggtaatgctttccagatacttctttttctttttccttacttttcacatttttttcttttactttttgtattttattttatgctttggatggggatgtaggtatatgtgagtgtatttgagtgaacacaagtatgttttttcatataggtcatgatgatgatgatgatgattacaggcagtctttctctgttgctcagactggagttcaggggtgcagtcatagctcaccgtagcctgaaactgctgggctgaagtgatcctcctgcctcagcctcctgagtagctgggaccacaggtgtgtaacaccaaacctggtagatttttaaattttttgtagagatgaggtctccttatgtttcccaggctggtctcaaactcctgggttcaagggattctcttgccgtggcttcccaaagtactgggattacaggcatgagccaccatgcccagcctatacagaatattattttgtatcgattattctaaaacggcttaattctttcatgttctggtgggggagcaggtagcagagtgttataagagagaatatcccagaataagtgaccagagaaatcctttttggtgaatgacatttatggtgagatattaaggttgagatctgttgtcatgctaagaatggggagacgaactttgtaggtagcagggatcccagttgacaaggcctttgggtggaaggagagcttggctcactcatgcatctgaaagaaccagggggctgaagcacacaggaaactggagagacaagatagaaggtgggcagggatcagatcatccaggcatcttcaaggccatgcttgtttaacttaatgtattgtgactgtctttctgtggtcaacattctaaaagcggtagattttggtgttaagagcctggccactggagtcaaataaatccattgtgtaaacttagacaagctaattaatgtcccctagttttaatttccaaatctttaaagggagatgattgtaggcaatgtctgaagggaccattggggaaaaaaagtcagattatacgtataaaacaatgaagaggctggcaccacttttaatcagttttatggttgaatttattcaacactcattgatggagtaaccaagggcttggtcaagaaaggttatttagcagaagctataatggagcttcaaagagcagagcagtgaaacttgtacttctcctcctcaccacctttggaataatgagcccaggtgctccattgaccagcgtcctcatgcagagccaagtgctattactgtctttttaagttcttaagggcagaaccgtggcttttcttacttgttcttacccagcaccatactctcactcaggacttttttcttttttttttttctttgagacagagtctcactctgctttccaggctggagtgcagtggtgtgttctcggctcactgcaacctctgcctcccgggttcaagtgattctcctgcctcagcctcccaagtagctgggattacaagcacgcaccatcaggcccagctaatttttgtatttttggtagaggtggggtttcaccatgttggccaggctggtctcgaactcgtggcctcaggtgatctgcccacctcagcctcccaaagtgctgggattacaggcatgagccaccgctcccagccagcacttttgaagtagagatggttggtgaatccacgtggaatgtctgataaataacgaaagccaccgtgaatcacagccttttctttccagaagggagatcacacttttactccagtgcagactttatgtatatagaaaaattgaaacatactttaaaagatgtttaaaatatatttcagcttttaaaaaggaggttgaaaatctgtaaaattgtatgattccattaaaaacatggcatacatccagagctcttgtggcacttgtatcaagcggtacagctatgcacactctctaaggcgggcagctgtaagggctgtcctctgcttctggcatgccacattggctaaatatatcgaccatcacctctgcatgcacagcagtaattattgacgtattcctgatggttttctctggctgtgaaattatgggaaattaaatatagtttatatttttacaatgaacacgtattacctttataataaaaaataaaattaaaaatcacttaaaatttcttcaattcttttcacactcctcttcatgtaacttcatatttgtatccagcactcacaactccaaggaccatgcccacgtattcttttagaattttaaaaataaattccagtaggtctttcaaatactgaaatctcagcactgaagtagattgcagtggggcatctgatgggtacatttcaaaaatgctcaatttgctcttaggagacttgaattggccaggcgcagtggctcacacctataatcccagtactttgggaggccgaggcagcaggattggttgagactgggagttcgagaccagcctgggcaacattgcgagaccctgtttctgaaaacaaacaaacaaacaaacaaacaaaaatttaaaaatcagctgggcatgggggtgtgtgcctgtagttctagctactcaggaggctgaagcaggaggattgcttaaactcaggagttcaaggatgcagtgaactgtgatcatgtcactgtactccagtctggacaacagagtgatagcctgtctttaaaaacagaaagcaaaaaaaaaaaaaaaaaaaagaaagacatgaattgtatgattccatttttgctttggtcatttactgggtgtaaactcttgggttttccttatctgtaaaacagagaaaacagggcctcctttatgtgagttatagattatctgatgattcaaataagatatgaaagtacttttaaactaacgacacaaatactagctgctatttatttaagttatgattcattaattagtgtatcctgtgaaggctccagttttgtttttatcaaagatcacgtggagaaatggcttgcattgggataatttataacttattaaaagtttgcttctcattaagggactattctctttggaaattaggtattaaatatatggtttttgtggcaacactgggatgtgtgctgtactgctcctccctaaaaaaagatcttttttatattttaagcattaatcagacttgaggctatttgctttcccatcctcagaccctcaagtgcttgttgtaggttggattgtgcttgatattcagaattgagtataaaagcatgtgctctgctcgtggttggtcagctgccttggagaggctagattcttcatcatggcacaattacagaaaaatacagggttttcctgagtggccaaaaaggagatgaggtgggtgttgggcaattaggaccttatttctttaagtttctcctgaaattgttaaagtcagctcacacttctttagttttttttttttttgccaaaacacaaggcatcaaataatgttggaaaatatccttggtgctcagctacagaagtttcttgaatccacaagtaataaggagctatttggcatcattaaatacggagtgtgggtttatcactccagtaaatgaatcaggagagaatactgagttagcttcctgctgagatgtggaggacacctggagtttatctagcacctctctgtgagatccctgagagcctcctcgatgagaatgcaggtttattccttctacctgctgaggagacagaaaattagcatgataatggtgataattgttctgtcctctggacagcctggacatcagggaagctttgaggtttcagtaaatgcttacttattcctctgctcttggtacaggcccgtctcttggtcaagatgagagatacatagaaatataatataagccccatctgtaaccatatgaaaaaagtaaaaagaaatagacaaattaattttaatgatctcacttaacatatctaaattattatcatttcaacatgtaatcaacataaaaattaatgaaatattttaaattctttttttagttgtatgctacatattcaaactctggtgcgtactttttacttagagcatgtctcagttcggactagccatgtttcaaaggccttttcaccacttatggctagtggggaccatgttggacagtgcaggtttattccttaccaacctggcccatagtagaaagtgctgtttccatgagacagcctttactcctcagtaagtatttactgggcatctaatatttgcagtttactacattttggttatataaccatataacttgaatttaatgaatgaatcaagaaacataataataaatagtataagtaaagtttctggatatctgtttgctaactgtatgatacagaagcagctgagtatgagttttcatgaatttgcagtgtagctttgggatcatccaagttacaattataggctaggtgacataaaagacattggcattggggggctttgtgtagcatcaggaagagctagacagtcatctcctaaaagcaggtgaaactgaaatagaataacgaacccaagggtctgctgtcgaagagatgtagtgtactatttaggtgtcagagactgaaaaaatacatagtgaaggtggctatgagcacaaactctagtagaagggcaggcattgctaattacaggccttgatttgtatttgaggcacatcttttcttgggcatctcctgagttccatgaggacagccaatgagtagtgcctaataattgtactgcctttctgccaggtgccaactcatgttcgccaatgtttgaatacattttcaaacttaatttttacaaaaaatgtcatgaaataggcactattattatctccattaattaatgatgaaattgtaaatacactgatgttaagaagtgggactaggaccacatgggtattaagtagagggaccaaaactttggcccagttttatccaaccccaaaacatataattttagcttataattctcttcaaattagacaataccatggctcaaaatataaataactagtcagagattaaaacatgtatctgtatgaatggagaagcttgattgcatgtctgattttaaccagcttagattaaaattaaattattaagtgtacttaaattaacttattcaagaaccaattcagaggccactttctataaagagccccacttcaagtcccttatttggaatgcatctctccttcctcggctctccccaaacaatttacacatctcttggtgcataataaccttctcttttgattatagttatacatgagcatgttttatctgccttttctctccagccactacgtgtgtcttgtacacaaaatagctcctcaaaatatgtttcaaatagatgaactaaatgactagatggatggaaagatgaacaaatgaataaataaatgaataaaactattcctgtccccttcaaaataagagaagtgtttgtataaattaccttgagagtaggtaaaaaccctttgcaaaaaaccccaggggtaaaaccctttgactatggcaataatatgcaacataactattgtaagaggagggcagttttaaaaattcaaatagtcatgtacttgaaatattaactattcaactatgcgtgtactggtttatcatccagcacatagatacagtttgtctttcacttcacaaagctagtttcatgcattttagaaaacgtgtttttccctgacccccctccaagctgtacttgacagggacaaaactgagagcattgggcactgcaggaatcattgtgagctttcaggaggggaaagtcatttctatgactagtacttttcaggagacatgggtgtggttttctcttttcgcatgttttagacaaaagtggcggactgatgagtttaatacaatggaataccatggcttgtgcatgagggagtaactttttacaggaatgtttattatctttgtcatccgaatccatatgccatgctcagaaaatacaatggatctgtgtcccgagtggaacagaaatagttttttcatgctgaaatgtgttttggtcaccatttgacatttttaagaagcagctctgtgaaatatttttgaaagtggatttatgtattcatattcattcatgtgctgttttttcatctatatattccccatcttattccagaaaggatttaagctggctcatgcatttgttgtatttggaatgtttctttataggtcaaggactagtttcccagtgaattgatttaaagaactgcagtcctctgactcaggcttgaattcacatatgatattggccatttgggatatctctctgttatatgggcagagtaaacacaagtataaatctgtgacaacattttggatttctcagatcaggtactccatcatctgctttttatcacgtacaaaagaaatacaaggccatttatttccctattaccctgtgttctggatttttctatttataaatgatattttatatgctctgtttagcagttagtaatgaagcataaagggaagccattttaattaatgccttatttgcatgtgtagcatgcacctcttttctttgatattattggaaaattattttaaattcagtcaaaagaagatgctttaggcaaatgaggacttgctgatagagagctgtattattttattttactaatgaaatgctgttaattttttctctgtattttacctgctgcaactggtttccttgactttgttcatactactaggatttttgcaaaaaacaaaaacaaacacaaaactggccataagcattgaatagaatcattgcaattttctgtcaaacgagttttgaaatacatctggtgtttaacaacacattgcttatttatttatttatttcaaatcattaactactattgcatcataacaaaacacacacacacacacacacatacatacacacacacacacacacagctttggttcaattatactatatagccctcctgtttccattgtgtttgggggaagtaaatgtaataaatatttttaaattcagtaacccatctgttgaattcttgttggaattaactgagagtttgtatggaaaaggcttagcctagaacttcatatgtatgggactaggggatagagcacttgaagggatggcatgggccccagggctgaaaagaagtgctgagttaggataggatataagaatatataagaataggatataagtgtggcagcgctgaaaatcagatggacattgcttcaaaaccgagcgtcgacacttgatctgatctgcctcttaaacctctttgaacgtctcctccctaatctgtgatggcagaatggtaatacttattttgaagttgtgtcaggattggtagcagcgtgcagagattacagcatgtattatgaactcataaataacattgcctggggtgttattttcattaacttcatcatcatcatcatcatcaaatataatccattgcttcaaagaatttatagtctagtaagggataaaaagattgtgtgtttgtattaaagatggggtggaattcttattaagtatcaatttcattgccaacatggacatggcaaatgacaggttcccccaaaaattattgagggaaactgagattagatattgaggagattttgggacaccaaaaccaaggcaaatgaagcactaaggcactcgacaaaatgagacacccatgaatgtccagaggtatcacctcagaagttggtctgaggggcaattacacaagcagagctgagcagaaacagtggcaatgaggggtgagtgcagccaaccaggaaacctgccgtcaattgtgttttattcttggcaaggccttatttgaagttttctttcttgattttgttcttccccgctactgctagccacatctgacagatacactaatatacgaaaaattaaataacaataaaaataactttataagacgtgcctcaaggcagaatgaatatcaagtaccagatgatgatggaaagaattctgctggagttcagtggacacagctgtcttatggcctgaggtgtaaggatgacactatgagaaagggagccttgacttcacttttgaagaagtgtgcagggagcacgctgggaaaaggagggctggaaaagagatgagatcttgctggatcaactgaagcacctgccacctgcttggcaggacaggaaatcttaaagtcaatgctcctcacccttagcaccctgcaaccaaaaagaaaattcgaagggttcctcactctatttgattggagttttgaagaatctgtggcatcgattcctggtgctttgctgcccaggcacccctaatcttagcccccaccactagggggcctccctctagtctccttccttctaagcattgatcacagcccactcaggtttaataagcatgactatccatgtctaaaaaaaaaatgatactttatgacatcaatttgttgtgaacttttcaagcttttcttcccaaatagcatatggatattcaatttggaaaattttgatataggtttaaacaaaatcaaattcaaataatctgtaattatgccaaccccagaaagctaatgcttttgcttatttttagatatacttccaaatttataatattatgaatagtagtacacgtcagtaagtacacatcttatttcacaaaacatgggctcacatttttctaattcatcttattcacttaatgttttgtgaacatttttccttgttatacatctacttcagtaacattttttacaatctgaacagaaattaattgtatagaacagaacaggattcctttgttcatttttatatatgtttcttctaatgtttttctcataacctaatatgaaagtgataggttgtggctacatgtttacttatattcataataacattttaggatatattttgccagaatgtattttatggtcaaatggtatttacattttaagtctttttggtatgtatttgcaaattgattttaaaatattgatattgatttatgtgaaatgggaatgtttgagagtgccccttcttggattcttagccaatactgaggcttgttataataaataaataaataaacaaataaaagccttttctcccactttgatgggagaaaaatgggattccatcatattgtcatgctaatctccactaattataattgctaattgtattatttatttgtatattcttgattgtgatttgtttgcttataatatttgcctaatcctggaggtatttatacttcattatcttattttagatagttcttaatatgtattaataatagtaactccatctctgaaagaaatgccaagtagttttgcttcacatagtctgtctgcttaatatctatctggatttttccccaagtcaaacctcttagtcttttcttttatggtttttaacttgttaagtaagactttcctcaattccaattattgaaatatctatctatctgtctacatttatgcctactatgtttatgattggattttttatttgtaagatttaatgtttcttaggttatttttgatgagaataaaggatccagtgtgtaattttgactgcttgtacatatttagtctgttttgttgttctggccattcctttttagtagcaagcactataacattcagggaaattttcaataactagtaatgcacatcttaaaaatgttctgactgttttcacttcttatgaaatttagacttatttgttggaactccaatacaatttctagtgaaactatgaatggaaatgacatttatgttaatttgagaagtaggttctttgcaatatcattttttatcctatagcaacatttgtctctctattcaagccttcttttctgtccttttgtggaaatgttatggttcccttcatataataaggtcttatacagtatattcccaagtgtttgcattttatccttgtctcatttcttgatttaaatggaatgccccaggtattatactatccagtttaaatgcccactattgctatttagacattttaaattaggaatcaatgttgaaatagttaacgactttttttgtcatctcatcatttgttaaaaaattttttgacttagttatattaggggttaaatttagaatcccttatattggcactaacttgatcgttttttaacaaatcctcctatgataatgttttgtattattacatgacttttttgaataacacaagtgcagttttgttacatagatattttgctcagtagtagcttttagtgtaaccatcacttgaatagtatacattgtaccacttaagtaatttctcattccttacaccctcacatccttccacccttccaagtttctaatgtctattattccacactctatgtgcatatgtacatattatttagctcctacttatagtgtgaacatgcagtatttgacttttcgtttctgagttatttcacttaagagaatggcctccagtttatctccattgctgcccaaaacaagacattgatttaataattaggatttcagatttacattcatataaaaatttgtctttagttttttcttttcctgtctttcggggggtcaggtgtgggcatcagttgatgctagattcttgatttgtaaagcattccatccttttcagtgctccagagagaaaatatttgaaagaatttacgtgtgagctgggtttggaatgattgttcttaaaaatatttttaaatgtcccaaatatttgctgacagatttatagaatgtctaggatttgcttaaaaagagcctcaggaacagcatggagggaggatctgtgggagtattataaaactctgagtatatgggctggttccttgtacattgttttgcttttatacatgtttgacatattcaaaaaagtttctaaaaatgaaatcacctgcaaaatgttttcagtggtggttacagattttctaatgcctctagtaattttggtaatttacatattattaggaaataatgagagtttaatattcttaaacatgtgtttttatcaagtctcctgtgtctaatatagtgcatttctgttttatctcttaatgagattagaatttcactttaaaatcatctttctaactcacaactctgatcagactacctacctgtgggcaactgctttacttactcaatcgaatttggaatgcggtggcgcgatctcggctcactgcaagctccgcctcccgggttcacgccattctcctgcctcagcctcccgagtagctgggactacaggcgcccgccaccgcgcccggctaattttttgtatttttagtagagacggggtttcatcgtgttagccagaatggtctcgatctcctgacctggtgatccgcccgcctcggcctcccaacgtgctgggattacaggcgtgagccaccgcgcccggccgaatttggaatttcttgtggggtaggcaacaaagccttcatgcgctgactccaggtgcctctcaaacctgagccccagctttgttttctcctccattttcccacactcctaagagacacttggaaattcttcctcctcagcctggggtgctgtcagctgtaaaacagtgtccatcttctccaagacccccggagaatgctgtttctcttaagccttccacaaattcccccttgttttatcttctgtcccttctctgaaccacataatgttttgttcagactgtggtatagccttaattgtactgtatgacgtttgcatgtttggaaacccaccttgttcttttttccacctactctgctagcagaggcctttgccctcaggtggcatggggagaatatttatagggtgagcatgtagaaacaggctgcgtatgtgccttaggccagcagtcttgttgtatgtctgcagcactgaaataggtgctcgttaaatgtttgtaggatgaatgctgagtgaatgcagtggacaggatacaggcaggtgattgggagcccagtaggactgaccccggtgggattagtagagagaagtagtgggagataacttggggtcatgttgtcattcacagtttgtggatgggagcaggtagggctggtggtgactataggaggcacagaacacgtacacagctcttgctcttcagaggttaccacaacaatgtgtatcttttccaactcataattagtagaaatgatgtttgtattaaggtaacagaaatatgctcctaaagtactttctcattatatccaaatcactttatcatcatttgttttactgtagttacaccacaatgtaaataaaagcatttagaaagacagttgtctgaacttcaaagctgtttacatagaggacatttgctagactgggcttttcctccatgtacccttgggtgagcttgtggtcttccccctaaagatcacaggctattttacaagttttcttgtgagctgttcagctttcttataagcatgagttacaccagggagttcatttgggtggacagagtccagaaatgtcctgtttcgactggtttgtttaagatggccatcaacatgtgaggtagggaatgtggactttctattatggggctttttaagactctagaccatcgttcgaattaatttcgttagccaaagttttaggccttttgtccagtgtgctcatttgcttcttggtttgctggtattattcagatcaaagaaggtcggtcactggaggaaaatggccagcatccataacaatgtgtacagttactgttgtttaattgagtggatttcctgtttgataattactattctgtagttcttgtgtgtgttttgaggatgagggaggagggacatatatgacatttgtatatttgcaggtgaaagagaaaaaaaaggcctaaagaaggggaataattaaatatgcttttagattgtcaagcttcctttcagtcctatgctctgtgtgtttgattcaaagctatttagagaaagtcatcatttgacccctgtgagatttcttccctgttgtgcttcaggtctcaaagagcttccccagataaattacaggccattaattgttaccaccaattatactggcagacatcaaaatgattttattaaagagctgtccaaagatgtaaaagcctatcttgacaagcatgcagccatgggcagtgtaatcactcgggaggcatgatatagagggaattgaggcacatgtggaacctttggtctagtctgactttcatcactttgtgcaacagaatatagaattgggaaactccatctaggaagcagaattctgatcacctgtatacagttccaaagcaagggtttgaattaatcatttctgcatttccaagacctaacatggcatgatgtggaagcaatagatatgtatggacttggatctaattctgaataattgattataattatcatactccagggaaatttgtaagggctgccacactgaggttgtgcttgcaaatatgaagtgcaaattggaattaattatcctggtcttttttagggaaatactttcttttgtcaatccagatgagtgatgaaaaagtaccttctggatttgaattagctggataattcttgactttgctcaagctttaaactggtaggagctttaatggctattaattagtgtgaaagctttttattttctgaaaaaactttttttttaaaaaaaaaagagaaatccatcttgattgacagatggattcctctgttttatgttttattgtttttgaagaaaggaactttgatttcctgccagggagctttcataaaaggaccttagcatgctgagccctgattaaacatcagggagacatgatgattcttttgtatagctctcccctcaaaggtgaagaggcctaaattacagtgactgtaagagaggtatctgctgaaggaccatgttcagctataggaaaaattggccgtggcatagacagcagtaagattgggatgcgaatgtaattttcctctatcttatgaatatttaaagaaaatttgtagaagcaagggccatattgctactttatttatttatttatttattatttttgagatggagtctaactttgtttcccaggctggagtgcagtggcacaatctcggctcactgcaacctctgcctcctgggttcaagtgaatctcctgcctcagtctccggagtagctgggattacaggcacccgcaaccatagccagatactttttttttgtatttttagtagagacaggttttcaccatttggtcagattggtcttgaactcctgacgtcaagtaatacatccgccttggcctcccaaattgctgggattataggtgtgagccaccatgcccagcccataatgctactttagagaagagaatatccggttaagctagagagtgatatagagaatttacccacataactgaaaactttttataagataaaatagaatttaatttttatttttttttaaggatcctgctaattttagcagattttatttatgccacatgacaagtgtttgtgtaattaaacagctcactttgttctgagtttactatgtttgcttcccaatcttttattgtggaagtcctacttattaaccctgccttcccaaatcagttatgaagataaaggtgtaaactaaaaaacaaagctggtttatgagcaaggttgagtaccagaaggaatggagttccctaaattataagagtttaatctccagttttaatccgtagatgtaccctgactgccacttattagtcacgtggccttgggcaaggttttaactactctgaatctcagtaaaagtatataaatgagataataatatttacccggaagaggggttgtgacaactcagtaagataaagtgcataaagggccgagcatgctctggattttatggcattgcgtgtggcgacagtattgtaatgtaatgacttaaaaataaaactaaccaaggagattctaatcgatgattggatcattgtgctccctgttaggccaagagataaaaataaattactagagaatttttgggtcaatggcaattcttcttttagcaagtataagatgaatatgatcatatatcctttacttacttttggcttgacacaaaacatatgcctaagctgatcaagaattgcttagaaagtaaacgccaaattattttttctgtttctctttttttcttgccttcataaactgaattattaatatcctatctgctgtaatttttattttctgtgtaaaggagaatggtcgtagtctaaatatccacctctgagaacttaaaggtgggtcaaatgttctaaaattacaacacctttgctaaaatgtcaattctgactattaaaagtgaatattaactatgttgagatcaacttaatatgctaaaaatgaactatatttgggttgctattaattaatgagaaatagaacaaattaagttcaagaacattaaaaatctacccaactttacatatttatttacttagtcattatttatttattttaaatgatagactttgtgtcttcgatttacaaaaaaattgattgggaagttcagaggttccataaactccctctcacccttgcctttagtttcccctaattaacgtcttgcattgataatactgtaaaccaaaaacaaaattctaagcccctcaactgactgatggaccccctcttggccatgagtattccaaagtaaacttgaaaagggagttcaagccaggatgcgaagaggggtccagtgtgcctcattatactctcctctctttggaactcagacacaactgatcagcattaaagttaaaacagagatcttaagactgagaaaacagattccttgtagcaataagataccaaattccaacctaataataataaatctaagtgacttttattataaataataaattggtttttacatatggattcatagttgtcaccaaatcaatacatctttacaagtaaatcacagcttgggttcaaacagattcaactgcaaatcttaaagaaatatattgacctcataataagctaaactgtacttattctcacttaaccactttgtgaaacagtttatctgctggttatttttaaaggaagtaacatattatgtagcatctacagtttaatgatgtacattctagagcatttgtccttaaccccagcagcaggttaccaccacttggaaagctttttaccagaatatccagagcctgtctcccctgcagggattctgattgaaagagtcactccacctccctcctctttctcaggtagtgcggagtttccccaggtgattgcaatgtagacccagcattaggaccaactacatttgggtcttaaaaacctcaaaactgattgaagccaagagatattaaaacaaattatttgaaatagctgtataaaaatccatcataaagaattgagtgctttattttaaaacataaaagctcatggcttatcaaatattgttcccaaattataaaaacatgaagcaaatataggaataacatgaaactgccctccctgccctacccttatgggtacatgggtacattccatgcagtagcaaaaatgtataaatatcctaaatgtccaccaatagagaagtgattgaataggtgtcatgtataatcataataagagccgtaatagtattttaaaaggtttaaattttaaatatatctctatgtactgaaatgaattataaacattatcagttagaaagtaataagacaagttaaagaacaatttttttttgagagtttagctctgtcaccaggctggagtgaagtggaatgatcatggctcactgcaacctggccctccagggcccaagtgatcctcccacctgagccttccaagtagctggggccacagtcacacactaccatgcctagctaatttttaaatttatttgatttgtagagacaaagtcttgctatgttgcccagtctgtcttgaacttctgggcacgcgcagttctcccaccttgacctcccaaagtgttgggattacaggtgtgagccaccacagggctgagtcacttttttttaaattgacttttctgtcaagcagagtggcctacgtcatgacatggaaaatttagtcaattatggtgaacaacctaataaatatttaattttgtgtgcagacaacctccctctccatctgttcttctcctcctcaatgtttctaaaatccctgcaataccaatctaacaaaagttggattcctctcaaatggaccttgatcatgtgcctaagaattaaaacataataatcctttgagaaacatctatgaaagatgcagtatgaaatgttgagaagtgagtttgtagcttccataccatgcttcggttgaatttcatttccaaatacccagcggccgttttgcatggtgtagctgggctatggagcccaggctcctcatgatgggttgggtgactgaaacacatttttttcttttaggtgataaccagctccttcatcaggcttctctttcccaagtttaggaagaagttgactacaatgtatttccctagcatgcctgttcccttgaacaaaggcaggttcaggagtgtagtgaagctccaggctccaaaaactctttcactctcattgcactctatccaatgtttcttaatgctaggcacagcagaatcacctcagtttattcctcaaaaatgatggttgaatttatctggccaggcattggtagtttacagaagtctaccagatgattctaatgtgtggtcaagactgagaactatgtgtttaattgggttcatttcaagaatactgtaaaaattttatctaaatactaaatatccataaaagaaacctcggtaatcaggccaggtttttgagtttttccagattagcccaactacaggggaaagagactttcgcactatatcccagagtctctgctcctgcttccagcctcaatgcactgggcctttctgctgccttggagcacttagagggattacaggaggagtgatctgtggagttttatctgctgtagacaggacctctcagtgatgcatgcagtcactgcccagggtgcagctggggaagtcacataccgtttcaactcaaactggtacactgcaattcagttctcataaccatctggagttagtgcagaccccataagttaaagagtatggtctccagcaagatggtcctcgcttcatactcagaggctgcaaatccctgagcttcccatgacgttcctgaagctcaaaaattcactagaatgacacagaattcaggaaagcattatacttacagttttattgtagaagatacaactcaggagcagctgaatgaagagacacacagggcagtttctgagagggtctcaaacagagcttttgtgctctcttcttgtagaataagggcttgtcactattacctggaaaaaaaaaaaaagaaaaaggaaacaaaaagacaaaaaacttggttcatttgcctggcaagtaacaaacgactctccaggagaacataggttttgatctataggagttttattacttgtcccaaggtaggagaacaccgggaatattctccaaagcagtgtctccccgaggaaaagtgacaggtgggttttatggagttgtggagaggggagaaggtgcatcatcgcatgtagaggaggggcaccagtggtgcagactgagacattatgccagcacataggttacatgttatggtgatgaatctgtagctcctcccagcgtagagactttagcatggtaatgaggaagcttcactcagattcatctataagttgctggggtctgtctggaactggttccagctgactaggtgactgcattccatggacggtttgtaaaaaacaggctgaaaagtgggaggctataaaacaggctgattgttcaagctggttaaacttctatagtccctggagaccctccctgtctgcttacatcactttcctggcacattgatgtattcaccaagcgggaagtttcagcaaacttccctgttcattacatagatgtaattgattaaacattggccccattattgaactcaagctccaactccctcacttttctggaggtcaggctggttcagagctttaactctctaattacatgttaggtctttctgttgaccagcttccattctcagtcatctcatctcatgagcataaactcaaaagtttgatccaagggatcatgaatatcaaagactcttctattacctgggaaattccaaggatatagattctgtcttccaggaaccaggttcaaaggccagttaaattctttattatgcaacaaaagatttccctgaaaccagacttagaagtcttgaaagagatgggggattcaatttccacacaatccctgggctctagaacaaaggctgtcatcactgtcctcccctggtccaccattttgggttgtggtccctctctctccttgggaactttttcaagaatcagtattcagtcttccaggggctcttcattttacttctataccttgagatttatcacctgacggtgcctattcttggatttccacacccacactctttttactattcattctctaaaagcccaactaaacaaaacacaatcagatgaacctcatcgttcccccttttcccaatagtacttaattgcccattaacaggagatgaagtttcggaagatactcactcccattcttagagagaaggaagtgtttattctgcatgcacttttaagaaaccaggcagaaagcttttttgtttcattgttcaggagagattatgactaaaaacaatgccattacatctcccattaaaaagagtctgaactctgggcaattcaggataaggcacgtgtataagccattcttgtgttgctataaagaaatacctgagactggctaatttataaataaaagagacttaattggctcatagttctgcaggttttatagaaagctggatgctgatatctcttggcttctgtggaggtctcaggaagctaacagtcatggtggaaggaggtgaagcaggagcaaacacgtcagatggtgaaagcaggagagagagattgagagagaggagagagagagagaggagagagagattgagagaaagagagagagagagagattgagagagaggagagagaggagagagagagagagaggaagtgccatacactttttaatgaccagatcttgtgagaactcacgtcatgaagacagcaccaagccatgagtgacccacctccatgatccacacacctccaccaggttctgccccccagcattggggatttcaattctacatgaggtttagctggggacaaatatcccaactatatcagcatgtaatctactgcttgacataggtaagaagtaattcttcacaattatttcaaaaccatttctgaatttactttggaatctaaagttaatttggaacaatatattttatcaaattagctccaaagcgatatttactcatgcatcatccctctgaaatgtactctgcaggttgtatgttgtacaatcttaagtatttcaattacctttaagcaaaaacagtacaagaaaggattagtcattgctgaaaatattatagatcacatagattcatttccagttttcagtgttgttttttaagatagtaggtgtttgatagcttctagtcaccgtccaaagggtcatggtctttctgatctttttgttcagaaatttgttctttctggtcaggcacggtggctcatgcctgtaatcccagcactttgggaggccaaggcgggtgaatcacaaggtgaggagttcaagaccagcctggccaagatggtgaaaccccatctctactaaaagtacaagaaagttagccaggcgtgatggtgggcacctgtaatcccagctacttgggaggctgaggcagagaattgcttgaacccgggaggcagaggttgcagtgagctgagatcgtgccactgcactccagcctgggcaacagagcaacgctccatctcaaaaaaaaaaaaaaaaaagaaaagaaaaaaagaaatttgttctttctgatcacatatgactcaggatataatgaaagaggatcaagcctctaagaagggtggactgaagctagcacaacaatatgcctgctatatgaccatggcagacttcttcctagaatccttcagatccacgatcttatctaattatgtataattcccacagcagctctgcaagatagatacttatgtcccaattttgtagatcagaaaattgaagttaaggagatatgttcattaatgaataagatggtaagtagtagacataggattcaattattattattattttattattatactttaagttttagggtacatgtgcacatcgtgcaggtttgttacatatgtgtatacatgtgccatgttggtgtgttgcacccattaactcatcatttagcattaggtatatcacttaatgctagggattcaattattttgataattcaagtttcttccaaagtgtcctatgagtaattgtttctacggtactctatacaacatatactttcaggcacctcttctcagttggtaagtttgtaaagtgttttcctgattggtacaagatgaaagtgtatgcccagcaggttattaaaggtaagctaactataagagtcattcattcagtatattttttatagagtagcctgtatttctgctacaaatgatgttggcatatatgaattacactcattgttttttctatttaataaacactgaattatgttattctacaataatggcatggtgaagatggttaaaagtagtgacagaaaaatttgactttttagaagcctctaatttgtgaaattaaaggaatgatttcttctaccatgaggtcatagatattgaaaaccatttggatattgtttaaaccagtttaattttatataatttatttcatgagctttcaagtccgtatctccaatgatcataccagacagatccccaattcagaagttatcttgcctctgacagtgcttacaacaactaataaccaggttcaatgacagtgatccagtttcggcaggtactataattgcagattatactgttcatggtttcttctttgtgtgaatagtaagtgtatgaaatcttcagtcaacatttccttttctgttgcataaacagtgctgaaagcttaatgatcagctggagaagaggcgtaatgaatagttgcagcattgttcattaaacaccgtggtggttctttctttgccatcatttcatctgtgcttgaattttgcatttccttctattctgtcattctccttaagcatcggacactccctccgtggtaattgctgtgacacacataaagcttctatcatacaacaatggaaatgtctctccttctccttgagctcattttattggagacactgtacttttgaggatggcaaatctatggaaagtgactcatccaagcatactgtaatagatggagagatttctttagatatatgtggccttttgtacaattaagcactgtattgcttttcagtaaattaagagtaaaattttaagtaaattgggtttggaattgggatttgcaattttttgctataatttattttagatcacctattacttttttggtaattttgtttctactcttacataccttgtgttctacatattgacaaatcatgctctatttgatgaattacatctttaagttattggtatgttactataggtaatgtttttgtatcatcttcagtagcctgttagcatattatgacaacatgctattcctatctccccagggccaagcctcaattaactgctgacactaagaggccttcactccagaagtagattccaaaacacatgttgcaatgaatagaactactttgtatttcacccaaaacatttaagccatggctgtttattacattgtgttattttattcatggattaaagctttggaatttggtaaaggaaaagattcccagagactgctattgaaatttcctagtaccctttggtttaaagtgtagaggaacaattttccagataaatatggaattcgcttttttatgttgttctttagagagctttagcctatttggcactaagtataattatctgcaaatatgagtttgtttggcaagatattcatgtgtccttaggtattaatatgtcattttggggaaaaaataactcaatggagttctgtcattatatgaataatttgtgatgagtaatttcctaagcaacatcagaagcaccagatgacgatttttgtttttagtttgcaaaatgcatttattgtataaggatgaaaggtaagtaaggaaaagataggttttagtagctgagaaactttagagtcaggttatacttaggtggatttaattgccatactttgttatagtggctaaagtagcccatttgtcatctgtgacctatttcagggaacaacaacaacaacaacaacaaagaaactgtggataacatcaccccctccccacctttgttgttcttcttgatgcctatttgacagaaggattgagcactttctgtttctgttgcatgggccactctctctgagacttctcccacagtattcatatccctgcttcaggaccacctcctctgaggagccttcctgaccaacctgtataaccctttgttacacaaccctttgttcctccttggagtcactttcactgtccagcttctcaatttacccagctttttttcattatacttttcagtgcctgaacacacacacacacacacacacacacacacacacacacacacacacacagtttcctgtgttaaaatggttaaaatgtcagctctctggggggaaggaactggtttgtcttacccagtgttatgtccccaattgcacagcagtggcgtgtttcagttatggtcctgcctgtgttcaccatgtaagtgggcagacatgatagaaggagatctattatacttccttgtgttatgtgcctatggaatagagggaacagtggagaaagtgaataattatacctgggacctggggaaaaaactgaaatgagaactgacatgttaatatatgtcaaaagattgagaagaggctggggagaaatataagaaaggagaatttcactcggagtaacttggataaaatctctgagtttgaaaagagtatggaacattcaagaaacagtgaaccaaactgtgattggagttctattcccaacagttgcataagggaaactgaaatgaggtgggtctggagaggtagcttagaattaggttttgaaggagtctctgtaggttactaagcatgatcagcttggtgttttatgactgtattctgataactgtgaaagatggatgggagggaagcaggaaaggggtcaggaagtagacagtgtaagtgaggatggttgtgtgtacagaagtgagtgggagaaccacagatggctcacaagagaacatgtgagagagaccctgtgtcagctacagtttgtattagttggttgattagggatattattttggttttgctccgtaaggtggttggggccgaagctctttctaactcaccaccctgctatagtcagggtatgggccttgctgtcatggtccaaaatggtgattagtgctttaccctccacatctgttctaggcagcatgagggtagggtccaaaagatgaggggaggggaagccatgtgtaaattgtgtttaaaaaattattataaaaaacacataaaaaattaatcatcatgtcatgtgtacagtacactaatgttgactctatgcacattgttgtgcaacagatctctacaacttttccatcttttgcagaactgaacctcagttccctttgaaaagttagactactttagataactcacaaacatgaaatcgtgaaacatttgtctttctgtggctggcttatttcgcttcacataatgtcctcaaggttcatccatgttgtagcatataacaggattttcttcttttttaaggctgaacgaattctattgtatgcatagaaaacgtgttctttaaccattcatccacggatggacatttaggttgcttccacctcttggctattgtgagtaatgctgcagtgaacatgggtgtgcaaatgtctccttgaggtcctgttttcagttcttttgaatatatactcaggaatgggatagctagaggatatgggtaatttatttattttttttgaagaacctccgtatgtttccatagcagctacaccattttacattcacaacagtgcacaagggttccaatttctccacattcttaccaacatttattattattattatttttaataatggccatgatatctcattgtggttttgatttgcatttctctaaagattagtgatgttgataatcttttaatatgcttgtgggccatttggatatcttctttggaaaggtatttattcaagttgtttgcacattttttatggagttattttgttgttgttgagttgtaggagttctttatatgttctggatattaaccctttattagatatatgatttgcaaatatcttctctcatcctctaggttgcctttcactgtgttgactgctttcctgtgcagaagttttcaagtttgatgtaatcccatttgtctgttttactattgctgcctgtgcttttggtgtgatagccaagaaatatcgccaaatctaatgttataaagcttctcccctgattcatccagtagttttatagtttctgggcttatgttaaagaccttaacccatttttaactaatttttatatatgatgtaaggctagagtccaactttgttcttttccatgtgggtatccagttttcctgataccatttgttgaagagacagtcctttccctgttgtgtagtcttgacactcttgttgaatatcatttggtcataagacctgagagtttatttctgggctgtttcattctactgctctgtatgtctttctttatgccagtactgttttgattagtgtagcctggtaatatgttttgaaatcaggaatcatgaggcttgcagctttgcttttctttctttgttttggctattcaggattcttttagatgtcataagaattttgaaattaaaaaaaaaatttctgcaaaatgccatttggattttgaaagggatttcaatgaatcagatctctttgggtagtatagacattttaacaatattaagtcttacaatccatggccatgggatatcatgccatttatttgtgtgtgtgtgtgtttttttttttccagcaatgtcttatagctttcagtgtacaaatttttgcctccctggttaagtttcttttcaagtattttattctccttgatgatattgtaaatggaattgttttcttaattttcttttttgtttgttcattgttagtgtgtagaaacacagacaattttttaatgttgattttgtacgctgcaactttgctgaattcgtttatgagttctgacagtgtgtgtgtgtgtgtgtgtgtgcatgcatgcatgcatgcaaaaattttaaggttttctacttataaaatcatgccatctgtgaacagagatcatttcacttcttccttttcacctgttggtgccttttagttgtttttcttgtctaattgctctggttaggacttccagtactatgctgaatagaagtggtgagagtgggtatccttgccttcttcctgatcataggggaaaagctttgaattttttcttgttgagtataatgttaactgtgaaattttcatatatagcctttaatatgctgggtaattttcttctattcctagtttgttgagcgtttttatcatgaaagggtacttaattttgtcaaattcttttactgtatccattgaggtgaccatgagattcattgtcctttattttactaatgtagcatatcccattgattgatttttcatatgttgaaccatccttgcatcccaaggatagacctcatttggtaatggtgtgtaatctttttaatgtgctgttgaattcagtttgctagtatttttttagggattttgaggatttttgcatcaatatttatcatagatattggtctatagttttattttatggtagtttctttgtcttgttttggtattagggtaaaaatggcctcataaagtaagtttgaatgtttcctcttcaagtttttagaagagtttgggaaaggctggtgttaattcttccttcagtgtttgccagaattctccagtgatgctgtttagtcttgggcttttgttgttgttgttaggagatttttttattactcattcaataatcttactagttatagagctgttcagattttcatattttcatgttcagtcttggtaagttgtatgtttctaggaatttatcactttcttctaggtttccccgttgctggtgtatgattagttatagcaatatcttattcatctcattatttctgtggcatcagttgtaatgcctcctctttcatttctggtttttgttatttgagtcttctctcttttttcttagtctagctaagggtgtgtcacttttgttgatcttattaaaaaaaaaaaacccaaatcttactcttgttgattttttcctattgtgtttctagtctctatttcatttatttctgctatgatctttattattttttcattctgctaactttgagtctagtttttcttcttctttttccagttccttgatgtataaagtcatgttgttgatttgattttttttatagaaatataggcattttactgttacaaacttcttttatattaatgcctttgctatatcccatggattttggtatgctgtgttttcattgtaatttgtctcaagatactttctaagttcttttatgatttatttttgactcattcattgttcaagaatgtattattttcatctatttgtgaattttccagttttccttttgctgtcgatttctagttttattacattatagtcagaaaaagatgcttaatattagttcagtcttcttaaatgtgttaagacttgttttgtgctataggatatgatttatcttggagagtgttttgcatatgcttgagaagaatgtgtattctgctcttattctgtggagacctctgtatatgtctcttgggtccagttggtttgcagtgttgttcacatcctttgtttccttatttatcttctctctgattattaatgagttgtcttttttgttttttagagtcagtttcactctatttcccaggctggggtacaatacataatcatagctcaatgcagccttgaactgctaggctcaaactatcctcctgccttagcctcctaggtagctgggactataagtgtatgccactatgctcagctgatggtttatttttatttttattttttgaggagatgggggtctcattatgttgtgcaggctcctagtcttgaactcctagcctcaagcaattctctcaccttggcctacatgagttgtcttttaaggagtgtttgcagaagctctttgcagtacattggctgaatctcattagctctctttggtcatgcttacatgcaaaaaggctggaaaatgtagtccaattccaggtatcgtgcacctctaaaaataaggattatattcagaaaaagtgaagaatagataatggggagcagactgcattgggtctaacatattagatcagaatctaatatttttaaggtaccgaatgtatatcctatcacatcttgatttggatgaggcttttcattttatagatggaggaaactctgaagccttcccttgtgtgtctgtgatatatgagcttttaacttctcatttatgaagttacaatagatatataattcttaccttattgtgtgttctctaagaagcacagtaaaaataaaatgaagctttaaaagtttaaaatgatactgcagggaattcaagatgaaaaagatatacaatgccaaattacttccacccatgttgttacataccctattaacagcatgcacaagagacaattctatttctagattttagcaccccatttcataatttttacttgtgacgaccagagaatatgaagtaggaagatggcctgtggggagatattatgcatttttgttattgaatctcaccactaaaaattgtgtttagtaatcacttctccatcacctaaaaattggtaacaggtaaaattgaaacaaatttcagtaagataattttgtcattgggtacctcacttgaaatgtgcatttctgagtggagaggaagatggatgattctaggcaatttatactaatttctacgtgtgcatctattaatttttgaagaaatactgttagcgaaaactgtaaatgtataaagtggttctgatcacagtggaggaatggaataaaaattaaattgaaagcctctcatgtcaggctaagagatcgttttaaaatcatcatgcttatttacaaaagctctgtgaaactggtctaagttaaagaagaaagaaaatgagttttagattagaagtgagttatggcccctgcttttcctagcagtatgtccagtttattcacagtgttctccgcagttctggggcattctggggaaatctgttcaggaataacccatgatatcttcttggggcttggagagagtggtaaacagacatactgtgggtcaaactttgggatatccatcctctttcaaccacagagttagacattgatttttacatattgaacttctgcattagcatttccctggaaaaataagtagttctgaggcaaaagaaacaaaccattggactaaatcatgctgcttttatctctcctccaacagaagactacattttagaagtcattttatcaaactttagatcttctcatccttttccttcccaccacctctttgtaggcctaaaatttcatgagttattcctatactttaaaatatatgcttggtaaaggaagatttatctttgagcaaatgaataattcagaggctagaatttccctgagattagtttacaaagtgaagactccaacccagaattcaaatttctagggcagaaaagatgtttgtgctgtttcctccacataacagaaatgcgactgcgttttagtgctcattgtgaacacgttcttggaaaaaagaggtggaatgcaagtcccagcagaataggcacattgtatatgacagatgctacccgctttctgaaaagactcatagtcctcagtttttgatgtaagtaggactcattacatcaaatctctctttaagttttaaataaacataaagttgtttccaaaataatacaccccctctataattaggtggagaaaacaactgttatcagccgttgactacacaagatctatatcagtccttgatgccttccttgaaaattccatttttcttatacatgctttggattatcttaaaattagctagatttgttttacattgtgaagataaagatttctcaagtttcccaactctgttgagtcaacattgagccccttatctttcctcaattcactgatctagctgcaatttctcatgcaatttccaattttgtttatgccgtttgaggacctcacatataccaggtggactttcacattatactaacacataaggactacgaggacagcaataactgtatccagatagccaatgaatagtgaattcagctatgatataattatcaaaatataaatgtacaagtgattctttgattagtcttttgaggattaataacgaaagaacctagaaacattaatattaatcacattagtttttagaacattaaagttagagtcttctaaataagaacattttctaccggccagtttgtgttttctccctataacctctatttttgtgtcacataatttaccttatcacatggacatattttacactttacatctcttatttatttaaattacacaagtagtagttgcattaattgctgggcatggtggctcatgcctgtaatcctagcaactctggaggctgaggcaggaggattgcttgagagctcaagactagcctggacaacatagaaagaccatgtttctacaaacatgaaaaaaatagccaggtatggtgacacatgtctgtagtttcagttactcaggaggctgaggcaggaggactacttgtgcccaggactttgaggctgcagtgggctgtgatcttgccattgcactccatcctgggctactcttaaaaaataataataatttgacgcattaagtttttgggttgtatgtgccatctttaacaattcaggcttcccccttactaatcttgtggaaagcatctcctgaaataatctcttccaatttccgactaaaatggcattgaagagagaaaaagatgaaatcttgcaacttccatcccatttccattgcataccagcaggcagcctactgcctggatctgaaaggggatcaatgtaaagatactctgcctagattgtgaataaagcagaagtgacttaactttcataagacccataaagtagaccagtcacactgccccaagaaaggaagaaaaacatttcaggccattgttgtttgctgctggcctctgaggccaaaggcttcatcagctagaaaacaatgtatctcttaccattacaatcgtggtgctttatactgtagttaaggtacattcttccactgatgatttttttcttacatttactcacagcttccacctccaagaggaaagtggggggtgctctgaggaagcatgggaactacagatgacttaccacattgtgacaagtgtagtctccacagttttggggctgtgacagcaagaacgtgattgcaggtgcaggtgtgctgagatggttatgctccagtactgagagccataggacaggagagggaaggagaagcttctacccccgtttaacagagccacagtggatgagtgatttctgttcaccagacacgcctgtgacatctacctgtttttaacttcagacctgagaaggtgatttaacagtcactcaaatggcaagtaagcagacaaaaagaaatccacatggcatgcccaagggcaagcgtcagaagagacaacatagagctcataatatacaaagagcagcagtgcattatcaacctaaatgtttacagaaagagtatgcttctgatataccaacgataaactaaaataaaattttagaaagtcattgtatagctacaagagagttttaaaaattgcataatatgcagtgtctcaagaaatatgtcaccataacctttacttgaaagactaaaagaaaacttaatttgattttcagaaaaagagtggtgaataaaagtgttttaaaaactgaaaaattttagtatacatggggaaaatgttgtttgaaatggttaaacttaaagatattggttagaaatgtgattataaaactaaatgattggtataggttagtaagtgtcagggaaaggaaagtaaacaaaaggcaatgatatgcctcatcttttgtggcaggagtcaaaagatgcaattcatgctgaacctacataggctgaaaaacaaggctgatcttccgtgagtcagagggagtcaatttgaattataggatgaatgaaacttctacgtatcctgagctctaagtcacagatggaaattatcccttccagtaaagcacccatggcacattttcaaaaactggaaatctgtttaccacaagtactgtgatataaaggcaaaatccctcagtctggcatgatctagacctctggggtgtgacttatttttgcattttaaccctcaaccaccacttcccagcaccaaccatagttccatccagattccactgcccctgagctctaatggtgcccacccctgggatgatctcatttctacctcccccagacctccttccacatcctctgcagagaggccttttgtggctcacctacttctcagggctctttctcttcctgaatccttgttctggtcattgtctgaatatctcacttgtcacaactggattggaccttattttgtccattgttttgttttttttccatgacttggtgttaattcctagaaggtctggatcgtataatctttacttttcttcttccttattctcctcactccccttcctcctccttctttttccttcttttatctccttctttctccttcctcctcttactcctcctcctccttctaagtcttcccctgcgctaggctgtagctcactgttaatgcttggttcactgaatgaatgaaaacaagaaaagttgtaagagccttaaccataacactgagttacattttgtcttcctttccttgttttaaattgcgattttgcccataaatgcattctggaaattgagtcattggcatttcatagaacacataatatctttgctctgaaaacaaaagcaatcttatacttcaaatctttataaaagtagagttaactataaggccaccttttacatcttgatacagtaggggatggtgttttgggttgaattgtgtcctttcaaccccccaaatttatatattgaagtactaactcccagcacctcagaatgtgactttatttggaaatagggtcattgcaaatgtaattagtaaagatgaggtcatactggagtgggggagaccgctatttcaacatgactggtgtctttatataaaggagaaatttgtgcacagacgtgcactcagggagaatgccatgtgaggaaggaggcagaaatgagattgatgtatctataagccaggaaacaccaaagatttgcaggaaaccaccggaagctaggagagaggcatggacagatccttcagaatctctcagaacgaacctctcagaaagaaccaaccttgctgataccttgatcttctttttctgaggcggagtcttgctttgtcgtccaggctggagtgcaatggtgcagtcttggctctctgcaacctctgcctcctgggttcaagcaattctcctgcctcagcctcctgagtagctgggattacaggcacccgccactacgcccagctaaattttgtacttttagtagagacgaggtttgaccatgttggtcaggctggtttcaaactcctgacctcaggttatctacccacctcggcctcccaaagtgctgggattacaggcatacgcccagccaataccttgatcttaaacttccagactgcagaactgtgagataagtcctgctgtttaagccacctaagttgtggttctttttaatggcaaccctaggaaactaatatagatggtggttttattaagaaaaagaaaaataaaggcactcttatatttgtatgtttatattaattgccccggaaggctcttggcagcctcagaggttttatagcccaagtatttctgcagggaaggaagggacataccacatgatgaaaggtaagtttttggttttctgtaatctgattataagaaggttgtgtatgtgagtgtgtgtctatgtgtgtgtgttttaataagaataacatgtgcagctaaagccatgggattatgctcacaggttgctacactcatacaaaaatgaaaatattttatgaatacatgagctgtccatcatgggcgtgaatctgctgattaccatagtctctcatgctccgaacagacttcttcatgaattttgagttatgcttggaaaatatcttgcagttcaacaggccaaatataaaccacgggctcttgcttaggcacgggcctggtcttgcttagtatcgccatcttccaaaacctaatctgtaactgtactagcttcctagggatgctgtgacaaagcaccacaaactgggtggcttagaacaacagaaatgtattgtctcatcattctggaggctagcaccaaggtctggagtccaggcagggtatcagcagtgccatgctgtctctgaaactataggggaaggacactttttttgtctcttccagcttctggtagcctcagccagttcttggcttgtggtagcataattccagtcttggtctctgtctattcgcagtatccaccctgagtctcttcatgccgtcttctctctatgcatgtccctctgtgtccaaatttccccttttcataagaacactgtttatgtaggattgaagcccactccagcaacctcattttaattccatcagctctctaaagacctcatttccaaataagattgcattctaaggtactagggtcaagacttcaacttatctttttggaggtacacaattcaactcacaacagtaaccaaaatgacttttcaggctggtgcccagactgcctgtcatctgacagaattttcatgtatggctgttctggttgcaaatagcagggcctcactctccccattggccttgatcccattgctcatagtggcattctgacattcttacaatttgtataacctttgtgctatctaatttgacccgaaagccccagagtaggcatgttctatgagtatgttgggtttttttttttctagcaggtaacatttccagattagccgagccaaatgatatggtaacataatagatttccacctttgcacacctgaagtgtatgacctagtctaatcactgactgtggaaacagtagctaatatgacaaaagtgccgtcggggacttcagcacttcattatcgcagggatggcttccaaagctaaccccctcagtgagaaactcaggcatcccagattccaggagttttggaatagaaccccgtatttgtattgtgttggattgataatattaagaagtttacttaacttctccctctgagtgtgtttccattttaaaaataggagtgttaatgcctcctttgcagagtagagagtgctcaacacatggtaagtgctccttgtctgaaggttgcttattccactccctaatcatagtggctacaaaagatcatccttcagactcaagtaactgaagcctgtgggcattacatattcttgtactttttcttctattgtaaaatctgcaggacacttgaaagttgttgtttatgttgtttgtgttaaaacgcttatttttttaagatgatttttagattcacaacaacattgagggaaaagcgagatttcctatacagccccttcccctactcaggcatagcctcacccattatcaacattcctcaccagagtggttcatttgacttttaataatctccaaacccttagattccagaaaaaaatgcataggttgtatagtagggaagaaggtcatagtttatatttcttgagattatacactttctctctcaaaccaacggttctggccatgtgaggattttgtcactcccagctgatttggagatcatcacttttgcaatgcaatgtggaactcttgtctgcgtttagccctttctgaggacacattctgtgttttgctagactgaggcaagttcttgtgctttttgttgaaacaggcagtgctgtacagtgggaagatgctggaggtacaaaggaaaggccaggctgtgaatcctaacactagcactcgttaggcaagcaatttcacttttaccagcttcagttttctcaaagtgtgaagttagagggcaacctataggcccatcctcatttcccacactgattgcaaatttgtgggtctaatgcaaattgcaaatatgagaatcctcaaaactagccctaggttcgataatgcactaggaagaactcatagaatgtgctgaatgctgtaatactcacaggtacagtttattacagggaagtgttgcaggttaaaatcagccaagggtaaagggacatggggcagggtccaagaacatttccttgtggagcttctagttgtcctctccccagggagtatggacaactttacttttctggcaaaaacatgtgacaatacacatagggtattgtcaaccagagaagttcagtcaagccctggggtacagagattttactggggctccatcacattgacatagtcgaccacccacatggcagatctcaggctcctgtctctgagaaggctgagctgataccacatggctcaaagctctcaggctgaatcatactgttaggctcttcagtgtgacccaaggccctcaggtaaacaaagacgctcttattacatatgagaatcataagaaattacctccaggaagtcaaggactaaggccgtacctcttttggggcaaggttaataaattctttactacacacatagatagaacaagtgggtaatccttagcgacctgtctagtctgtaaaatctacagtgatgcaaatgtgcagccctgcttaagggcatagccaccgtcaccttgtttaggaactgtcagatctgccctctcatggccagatggctgcatcagcccactggtactctctgtgtgatatgcccgagggtttagggatgtttcagaaggctagttgtatctggcaaatgggtaactcttaattattgtatgacatttttttctgtatttaatggttaagatttagggaaggggcaatatgtgaaaaaaacacgttatgagaatgtttcacatttagaccttgagaaattggtatttatttatgccagttacctatgtctctgaggtgccaagaggatgaattaatattttatttcacttgtggagatattcagaaacattaaagtccttggtcctcatgagaaaagaattttcttgagacttgaaagcattactgcagacattttgctaacacattttttgtgagctgtgttaattgcacctacctttatcagtcagaagttttgctgatttaaatcagatcccagctaacccaagcggggctgcactgaaggccacatctctattgcccagatttcccaggggactctggaaattaaccagaagccctcctgctcgaagaccaactcttgaggcgtatatgatttgcatagaggttccaatgtgccaagttcttagaagtttctgggagccatacagatgattactattccaaatgttctcatcttgggttccaccctttttattcaatgagatttgacttttctactttttcactcccatcttcaccacaccaaaattcatatctaacagtcattgtgtatattatgaaagttggtctcaatttagtcaaacctgggtttcaggggatatagctcacataaaaaggaatgggaggtatcattatatggaaatacctgctgtgtgccagagcatcctttaaggtattttgttttctgtgatattttcaaaccctccactttacagatgaggaaagtcaggcccagagaggtcaagaaaatcacttcaggccaaacaaggtcacatggaaaagtagggattcctgtgaactcaccctgtgttcttcctactccttcatgctgcagaaactctccctgaatccaaatgatgccgctgctgaagtgtgggctggttagagtgcatcacacagagccaagcctcattgtacgggaaggtaaactgctgccttcagatggattttgtgtatctatggatatcatcagttgcccagcatttctgtgttatctgagaagtatttcattgtattactggcatgttcatggtgaataaaatggcaaaagtgttattaaattatattctttgctgtcccccaacacagctataaaaggcaacgctttatggaaagaatgatacattcaaaattcagtattcatcttttgctaacattttcctggtttgtgtgtgtttttatttgaatacatattattagtcaatgtagccataaactgaaaacctttgtgtttgaatttttgtaaattgcaatcttgcccttgagaaaaaaaaaatttaaaaatgctatttatgcttgttactactaattagggtggacacaaaacaatcgaatatctggatttgaccattggagggttacagattggttagaacatcagcatttatcatatttagatgactgattcatttgcagccagtcatgtggctgctgaaattttcccttaagtcaacgtttctgatctccatatgtaggagagtcgtaccaccgttcaaattggcattgatcaggaagggccaagagaattttcttcttctctttctgaagtggttttctcaggcaggactgagagaagcttcaacagttgaacagctgttgtctgtcctttttcctctctgtaaaatatttcctgatttgcactgatttcccttcctgagacttgaaacagcaaaacagaaacaaattaggtgtgtatcaggaatgaaatacctcctgtttattgagagtttaataataatctttgcaattagcgtttgacatcctggaaactcctactgctgagcttatacacacacacagaattttcaaacccaatgtggccaacacccccacagacacctggagaattcaactgctcctagaaaaagtggattggaattattttattcctttgcaaactttttgttgatctctaacctattggggtccaagcatgaaatggctctgttgtattcaacttctgacacttaccctccttaaattggtcaggaagccccttttgtgacgtcttggataaattttaaaactttttgttacagttgcttattttaagtcatgccaggtcagcaatcccattactgggtatatacccaaaggattataaatcatgctgctataaagacacatgcacacatatgtttactgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctccctcacaggtgggaattgaacatcacacaccggggcctgttgtggggtgggggaaggggggagggatagcattaggagatatacctaatgttaaatgacgagttactgggtgcagcacaccaacgtggcacatgtatgcatatgtaactaacctgcacgttgtgcacatgtaccctaaaacttaaagtataataataataaagagtcatgccacttattatgccttagtccggtccactaaaacaaacacaaagtttagttcttccttttcctttcctcaacctgaccaaatttgtggtgatttcacttatactattgaagtgtgcttgtgtgtgtgtgtatgtgtgcgtgtgagagagagggaggggagagagaaagaaggcggcaggggggtgcggagagagagagagacctcttttttaccccatgagtagagtaaggagaaagtagaagaaaacaggcatctccctgcttatgcaagacttgtttcagataactggtcacccaaatggtggtctcagcctcagaagttggcaccccagttagttcattcctgggtttttttgtttttcagtgacacagggcacttttttctacctgtgttggagtagagtgtcacaataatagctgaatggagccttgaactcctggcttaagcgatccttccacctcagcctcctgagtacttgggactaaaggtgtgcataccctgcctggctatttttttttaaatttttatttttgtagagaagagatcttgctatgttgcccagggtggtctaaaactcctggtctcaagtgatcctcctgacttgggattacaggcatgatgcaccacgcttggcctcaatcctgtttaactgacctcattggacacttggccgttaacttctggctggccaggctaatgcttctctgagctgtttgtctctctggcctcatctgcagcaggccctgcaagttggtcacctgcaatttcatctgccatccatagcactgactctggatcttgacaggggacttaggggctcacatttattttctcccctcctcttgcctgtactgccaggtcatttctctctaacactcttcctgaattccagtagcaaaggtctgtgatcctgtggctaggtagatacccacaatagaactagctgtttgtctccattcttgaagatcctcccaaacttcacaagtctgttggttgagagccccatcctttgcttgggatgagaaacctatggagaggggtatgccccttgaggtgatttctgtttgtctttccatccttctcttgatggctattatctcagtggaaatagacctaacaccccagagaatcttataacttggttctcagcagggctctgtctttcctgtaattactgtgtatttgattatctctggggctctgaaaagacctcagtctgtaccttccagtccattctgatacattcttgtgaatcaccaagtccatctctttttctatgttggttagtaacccaagaaaataggagattgataaagtatcacattacagaacatttaaatagtatcatagactccattgcctttcttcccagaatgtgagtcattgcctttgtgatgttatgacatagtttatagcaaacataaaatggcactgtttaattctgctctagtggtcatcaggatctgaaaataaaacatatcaccagagtttttgatgactccagtctcaaattttcagtttctttgatttttctaaaatgaaagcagaactttttcatcctgtctttgtttatggcttatgttgtctaagcaggaagatactgactcattaacatctcaacatttttggtagaactgtaaagagcttttcaactttttaatctgaatattgggaagtcagatatattgaattagacttaaaattgggtagtgattattgttcatttcagtattttccaatcaagctgacagttatgaaattctaaatcaatatatttgctttatcttttatatctttaaaaatagttaggcaggtatacaagagttggggtatttctatatatttaaatatttttaaaaataaagcatggaacattttgaattcattgtggatgagggggctgatgagagttgaggtggtaagagcagagttaatttaggaagcagccctgttgtggatgggaaatgtttgctgctaatgtctatttttctgtgctggagctgacagaaatttcctttttgtttatcactttgagccttttgaatactggcagtcatgacacttatgaaaatgtatactatatagttaatgtccttttttaatctcatggaagtgaagttattttctttctttgattgcatgcaatggatgcttctaaaaatcactctctagtgattcaaatattagattaacataccagtttgctgagtaaattctctgaactctatcagaacaaagaagaaactacaagaaaacaagctgaactcaagagcttgctttctctctctctctattttttcttttggaccccacaatttccagctatgtcttagggaatcagctccaaatcagtctgctgctaaaatgatcattgtgtacacccagaataaaacataaaaatatctgcattcacaaaaggaggggtgggtgtgaatgagggcattctaaaaaagggtttaggcattgtagacatttgttctagacaggttgttaaaaatcaacatgaatgccaaaatccaggaaaagaggaaagagcacttcacaagcagtcctgctcatatcaccttgcctgtgtcacaccagccactgctgcactgtaaccactagcagttttaagggcctcactttcacctaggattttgcatagcattgactgtcttgatatgatttcacatgttatttatgtcaggattcagattactgaactggcatgagttgtgctcatgaaaaaatataactaaagtctgtattagtgttcttcagagaaacaacatatatgtatgttctgttacattatatatatatgtagatacagatatatacctgttataaaatatatgtttgttctgttatattagacatatacctgttatataatatatatgttatatagaatatataatatatataatactatatatattatatatatatacacacacacatacagagagtgagagattttatcataaggaatttgttcaagcaattgtggaagctggatctggttaagtccaaagtatgaagacccctatttcccagttgaaatctgagggctggaagctctgtagaacaggagctgatgtcccagtttgaaggccatcagacaggaggagctgatgttcctctgggaggccaagttgtgcaccacttttgcagaaataccagtggccatttattttagttctgcatttcatagccttgtcaatgatgaggactgattgggatctgtatccagctaagggtgattatgagaattcaatcaaatgtcctgtcaatcttgacctgtggcaaatgggcttaaaaatcatgttcactagatttcattacagcatcttattctttaaatatattcaagtacctacttagtagctgaagaacaggctggaaagtgaaaatcacagcaaaataaaagttgatacctttgaggaattgagtgatcctgagtgtagccctgatttatcctttttttccagctaaactttctgtttaggtgatctcatcagattcatgactttaatattctccatgctgatgataccaaaatatgtttctcagactctgacttctccaataaactctgcactcatttatccagctgctccctcagtatctccaattatgtgtaatagacaccgtaagctttttatatccagaacagaattttgagtcccttgcctagaaaaatctgatcatcacctggtgttcctcatcttaattaatgacttcatttgtcctgttgcttagatgtggcagattgtatttctccaaatgaccacagcaaagatctcatcccacgtgcttttcttacagtgtaactttggtattcatcctatgagagttggggtctgtaatctttctgcttgaaactttgtggtggcttttgactgtccccaccaatagaatacagtagacgtgatgtttggtgacttccaaagctgggacaaaaggcaaaacaacttccctctggccctcttaggagatgcttgccctggggcaagccattcaccaagctccaaggaacccacactcgccaacatggaggaaccacatggaaaggccaactcagagggacagtgagttccaggctgaagccagcatcacttgccatagatgtgaataaaccagctttaaaatcattcctacctctagcttttgagtcatttggtgatggtccatacactagggcagacatacccttaaactttgagtaatttgttatgcagctttagtgactaaaacattgcaagataatgcattagccatcctgattcctctcattcacacacccatatatcctgtaactgtactttcaaaatatagcctgcatgctgaccacttcttaactgtccaccacagctggtcctgaacaccatcacctcttgccttatttactatagatgactcctaactggtttctctgatttttccctactacagattatattttccaagtagaagccagattgattctttagaaacgttcacaagatcaagtccctattttacttaaaacctccagtaacttcctatcacatttaacatactaccaaactcctcactatcccctattaggccctgtgctacctggtgtctttttctctgaactcctttctaccactctcctccagactcacaatactcaagccacactagactcttactcttccctaaaacattaatctctgagccatagatagctaacagcagaatacatgcctgtcttccatagctgtgggattgctcctgggtctgcaatgtccagctctctttgaacccataagattaattctcaccagtaacatggtgcttcttggatagggttattaggaagcaagtgtgctgccctcactctctggatgccaaggactccatagccctaggtgatggcaaaacttgaaggtggaggcagcctaggtccctgaatcaccacatggaggaaagctgtccatcaaccaggaacgcctgcattggactgtgaatgtgaataaaacttagggtgttgttaggctactgaaattttagagctcattcattatagtacctggtatttctctacctaatagtgttattccctcctcaaagcctttatattggctactgcctgctgctcttctctcccttacatcattctctcccttgcatcatgactctgccccccatttaaaatatttaaaatagtcagtgctcccacccccacacgaatttatactttgtcatactaccctgctttatttccttcatatacttatcactgtctgaaatattcttatgtattttattttacttccgtttctagtagaatgaatactttgtaatagcagggacctggtctgtctttctgttactctattcccagcacctaggtggtgcctggcatgtaccagtgatcagcatttgcttctggataggagcaattacatcaagtagaccgagaacaggaatgaagagttgggaattagggtctttggaaattaagttagcaccacttgataaatgattcaacttctcagtgccttctcacaattgtcaaattgggataatatctattttatggaatagtctgatgattaagtaaaatttgtatgtaaactgctaagacctatagctttttaaattaatatttgttcttatttcatgcaggtttggaggggaggaaataattgccaaccttaacatttattcttctaaaataagtgagggcactgccacatttgatataagtctcatagggtggcctttccagattggagtagtcaactactaggggttgttaacacttttataatatgaaggtctgttagtcagatactttgacacatactacagcagggaattttacagccctggcaattgttttgaccatcacaccatctctaaatgatatgatagaatggccacatcctgttctgactgagccgtgcaagttctgcctttattagtttccatgtggtattgtgaattcacagtttggtggttggaggtatgtagatgacaaatctttgtttattcagatctccaggaagcaaatggtattcttttgcagagtggccaattcaggaaaaacacgtttataagctattgttatgtttttcaaattaaaaacatgaatgaaacataagagagttatattgtaatactgaaaaatattgaggaaaacatgaaattctcctctcccttcacctcttccaagtttcctgtccaagaaaaacttgaaactgtcaaggaatttagtgggtgaattttccacatagatggtattgtgcccaagggagcaaagatttgttttggggaggagtgaaaaaattttactcatatgcgtaaagtacagatatacatataacacataaacagatatacaggctgggcatggtggctcatgcctgtaatcccgccgaggtgggtggatcacctgaggtcaggagtttgagaccagcctggccaatatggtgaaatcctgtctgtactaaaaatacaaaattagctgggcatggcggtggatgcctgtaatcctagctacttgggaggctgaggcaggagaagcacttgaacccaggaggcagaggttgcagtgagccaaaaacaagccccactacactccagctggggcaacagagtgagactctgtctcaaagaaaaaaaaataacaaaaccaaaaccagatatacagtctatgtgggatattaaaatttcatggcgaggggatttcatgggagtgattaggaaataaatgtctacatttctttaggggagtgatgatgaaatgaatatttcagaaacagtggtgtagtgtttatcctcctgttgccttgtttgcacccacacacaatatatatgtataaatatttttgttgttgacttttataatcattggaatatgaataaggaagaatgttgcacagtcactgatagtcatctgatgacaggaaggggacccagcattggcttgaggcctgtgttgtagatgtcagatcagagaactcccttgtgttgtcattgtgctactgcctcaaataactgtgaaacaaatactacccccaagaattcccagtctatgaaataatacatatcctcatggtttgaaccaatttgaatcatgctttctagcacttattcccaaaaatgtcatattagaaagcaccctataccaattaacactctcatatacatttatatgtgtgctcatatatgagattctcttcagaaaaaaaaaatctatactatatttgctggattgcttactgacaatttgtatcttattacagattgtatattaatttatactgctcacttctcctttggatttgttgtggttttcttcatgcttttaggacctttttatttttcctgatgtggtctttattgttaaaatatattgcaaatatgttctccaagtcttccacttttaacttcattttttttttagagatacagaagggcttgtgaaaattatgcattctaggttgtgtcttgcttagggagaccttcccagcccaatactatgaatagtttccactaacatcctttggtaaatgcatagttttactttttatggcttaagatgttacatagaggttacatgcatatatggtggatatatgtagagtgtaatgtattgtgtaagtttatttattttttccctaaatcagtaactcattttctcattaccatttactattttttacttttctcactaatttggaattctaattttcatatactaaattaatatgcatgcctgaatttgtttctagattttctaggtgggttacattcatttctccacattttcttatgcctatattaccctctgttaattactgtaacttctttgtgggttttgtgggatggttgcggcacatgttctattcacaatccttcttcacattgttcacttttaaatttttcttgctgttatgtattttaactcaaatgaatatagttttattgtgtttcagggttaggtgagcagagagagggagagttttcttactaaaatttaatttatttatgtaattgcatagatgactataacttcaaattctcatggctatttctttatccaataaattttttaatgttgtggcctttttaggatgtagtaacttaaaggcaactttcttacctttcaaccttctcatttgtatcccactttataatttaccgagttagtttgcattttctgatttcttcctcaatggaaccttatgaaaggtttgtaattttaatgtccatcttcagaagtgaaaactgaaagtcaaaagaatgaaataattgagtaagtcatatagcagcatagtagcagtaatggaactagaatttgtctgttccacttagtgcagtgtctcggtaattagaacaaactaattctggtatcaagcgttacactttgtttactggttaaagagacatacgagatttcctccatactgtcctgcagcctgggcgttcctttgccatagttgctggatcgcctccctgtttgaacaaaacaggacagaggaaaaggtaacctggaggagaatgccacatccgctgatttcaggctcgatgaagttcaacacttcctatttcaaggtggtgacaccctctacaaatccctggctttaggaagaaacctcttgataaagacccctcatccacagagttgcctccaagcctatccttgttctaatccttcttctctgcatgaccaaaacttggtattcaaaattcaatcttagtgttttctggctgtgctaaaggggatgtggggacctcatgtttggcttacctgcaccttctaagctagcaccactgtcttacttaatggactataatttcatctccttaagctctcttcagaatgctataatgaaggaggtgtgacttgggtttggaaatgtggtggcaaattatctatatatgaattaacatgtataatttaatacacatcatgaataatgatgaattgcaagtttaacttgatcatttaagtagagggtaaaatttctctttgtccctggtatattttatagagtaaatattaaaatttgatactctggctttgtggatatggtttcatgatgtacaaccactgtttctaggcagcccactccccagtatcacattgtagacaccttgaggacagggagatcttctaaatctgcttcatctctttacttcccaagacaccgtgaccaggctctagcatagaatatttgtttgctgaataaaggaattaatgaactaatgaactaatgaactaatactactttgcacttcacacatctctcaatttcctttatttttgtattcatttctagaatcatacagtgtaaactttaggtaacaatatagagataacacttttcccatcctgtgcaatggcattttgccactagcaggatgcaggagacaattggaaaggaaacagctttaactgtgtccattttggccagctgttctttgtaaaaggtctgtgataaaatttgatataattcagcacattttgcattagttagatattaatgttaactgataacttttgctcctgttagtatagaaggagtttattctctatgaacttgtcccacaagaagcactgtcaactcagaaggcagtagccgacgtttttggtatttgctccaggttccttttcagaaaaggtcattgttggatagaaaggcagcatgctttggtggctctaccaagtggagtctatgaatcatcacctggaactatgttaggaatacaaattcagtgatgcccttcagccctattaagccaaaaactctgtgtaggaccaaatagtcagttttaacagcctgatcatgtgattctgatgagcactaaaggttgagaaccttgactctgtggaaaaaaagccaggatctgaattgggcagaactgaatcagaattttagctcagccatgtattgtatggcttcagccatgttaaagaaatctcagccttggtttctttatctataaattgtggagcttaatacccacttcattggttattaaatgaactataaaatatcacactgggcctgccagtagaagccagtcaacacatttagggttgtaatttcctttcctcttgctaccaccattgcatgaaatctaaagtagaaatagtagtttttaatcctttagatatgttattatgtatgatagtaatgtatagggtttctataccctgagctttggagttgacacttttctgacaaaagaatgtgatttacttatgtattttagctgataaatcctagatagaaatgtatgttcccgtctccctaaacatagtagctgtctgtaatcccatgtgagtcagagatgttccagttattgactgctgcataacattctaccccaaaacttactaaacaactatttagctttgctcatgagtttgcaggtaagaaatgcagggaaagcttggctagcggagtagtctctgatcagtgtgttcttggctagggtggcaggggctagaggttcccctccaagatggctcctccagtcacatgtccaacctccttggagctggtcttgctctcacatggcatcccatcctccagggtctgtcctcttgttttaggatttccacagtatggtggtcagggaaaatgcacttcctgcatagtgattggctttcacgaggtaggtagtggaagctgccaggccagttaagacctctgcttataaccgacacaactcgccctgttgctcagagcagtcacacagcctgctcagagtcaagggagagaagaaatagattctgtctctcgttgggtgagtgacaagtcacaatgcaaacaaatgtgtgggatgggagatgttctgctcatctttggaaaatatgatctgccacgagggctcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccacgagggctctttagtagggaatagtatgttgttctttgtatgcagctgttaccaaaaatgcttaaaatagattgaatttaacgattacacctaaacatacatacatgtattttaattacgtttgttgtctaagttttgccttttaatccttagcaatgtaatttgagtcaagtcaggtgagttgttagtgtgagagtgagctgtcatgtcatccatccacgtccccgcttggactgttttacacgacgggacacacgtccactttcatgatgcagtgctaagggttgctctgtcaatgtaaaagctgtgtccgagcctcagggcatgtaaccttacagctccgtggtggagttacatgctttgttgctgaaggaaggaatgttttcattagttttctttatttttgttccctcagtgggatgttattagtcatgtagaggcagaatttctgtcctcctccacctccaaccaggaagtattaatcactgtttcatctgtgttttcgtagcatttgggttattatattattgttttttgctgattattttaatcgtacaaaaaatacatgagtacattctgtttataaaatttcaagcaataaaaataaaataagtgttcacattaatctgcatccattttcccatgctaatcccttcccagagataagcaatgttatcaattttgtgtacgaccctccagacatattctctgcatcaagatatacacagatatgtgaacatgtataatttactccaatggaatcatattctatatattgtggtttcctttattcatttaaccgtattgagttggagaaatttatatgtagaataactttattctttttttaaaaaacagctgcatagaaggagaatcacttgaacccgggaggcggagaatgcagtgagccaagattgcatcgctgcactccagcttgggcaacagagtgagactctgtctcaaaaaaaaaaaaaaaaaaaaaaagaagaatattagaaaattacaaaaaaattcaataaaaacatctgcaacaaattccatctcatgaccgtacagtagtgaatttaactcttcccctacagatgaacgttgagattgtttccagattttcactgaatacaataccctagtaaaaatttctgacattgttctttgtgcacctgggtgagtatgtgaccctgtgtctagaatggaatactggatcagacagtgtgcatgcccttatcaaagatactactgccagactgtcttccaggaaggccattccacagagagtcaaccccctaccacacggcctcatcaatgatggctttttttaatcttttctgagttttgcatatttgataggagaaacagatatatccagttgttgtctttccatttccatgttcattaattaggtgtcccatatttttccgtgcttattgagcatttgtatttcatcttctgtgactatgttttgttcattttattatggataccatagaagtgtatatgttttcttgaaacttcattttgttccattgataattattttattcttgggcccaaacatattaaaatgtaacatttacccatttaatattaatttaatacaaaatatataccaagcatcattgggcattagaacattacaaatacaagggtaaagaaaacagacaaccagctgtgttcctgacgaatttccggaaagtgctgaagtattaaaggtccatcctaggccatacctacatgggtgaccctggcacaggcctgagtttttgctggtggctctggttatagtatattttgatatctggtaagatatctgagaaaaatttctgtctctctctgtcatctatcaatgaattcttccatctttctatctactacttattagatgtggggacttagacaaattcttatcagatgtgtaatatagatccaggccatctggcttcagagtttatattctttcttttgtagatttaatagagtttatattttttcttttgtagatttaatataaaattgtaaattttagaacttgtcaaatttcatagaaaagtcatttgggactttgataggcacagtggggtgtgtaataatgtattaaatatttttatgatactgagttatcccacttagtaccattgtagaccttcattaaatcatctatgattttatgtcatttccataattttgtccttgctcattattagatttatcctcagatattttacaattttgtgctgatacaaatgggatcttaatagcattatctaactcctttatagtgtaatggaaagtgtgaattttttgtatgttgaccttgaatctgtatattttgatgatttgttggtgtgtgtcctaagagttgtgagttgatagtctttgatattctaagacaaaaataaagacagttttgtttctttcttctaatcttcctaactcttatttcttatttctaaattattattattatttggtgtatgtattcaggacagtattgaataagataagatgatggggaaatccttgtattgttttgaacattaatggaaatgctgacttttttctgaacatttagtataatgtatactttaccttggtgatggataacttttatcaatttaagtagttttttcatgctttttcttgtactaagagcttttaataaggaattgagtttgaattttataaatgtttttcaacacattcaaaggtaatttactttttatatcaattaatgaattgatttacattaatatacagctaaatgttgaactctttatccctgaatttctgataaaagctctaccttgtcataatatgttcttttaatatgctactaaatttttaataaatttatttttatataaatgtaatatgtgtatatatataaaatatgatattatgtatatataatataacctttttctaatgagtaaaaatggcccacctttcactgccttatcctcttgtttctggttttagtatcagggttaactggctctgtcagatgagttgatttttcttatattttctgttcttctatttatttatttatattttttgtagaaatgggagtcttgctttgttgcccaggctggtcttgaactcttgggctcaagcagtcctaccaccttggactccaaaagtgctgggattacaggtgtgagtcattactcctttctattttctacctttggaaacagatttcctaatataagaatgatcaagacatgaagtctgatagggtctacctgtacatcagtgcaggcttgatttcttcaagtcatcttactagtataccaactttctcagtggttattttactgtttagataattctctttgacccagttttggccatgtagcttttcctaggaaattagtcctatcttttagatcattagttgtatgaaattttttatactgcaagtaatagtttaataaaatcatatatgtgacatcattaataaatacaaattttatctatagctttgtcctttttcatgctatttgttttatatttgttctctctctttattgcttttaataggagataggttatgaaattaattgagcatgtttgtcttttcaagaacattattttaaaaaattttctattttatacacttaaggttttattttttactaattatttataactttatgttttgatatatttatattttaataggtccctaatattcattatgtatcatatatttgtagctataaattttcctttgaatacaatatcatctataattcataggtgttaagttttattgctgattgttgtttttgtataagtagtttgtgatttccctgataatatttatttaatccaagtttttaacagaagatttatcttaacatttttcccttgtgttttttattttattattgtataggttttttttctttcattgtttatgaatgttgaattttatttcataattgtgaatgggactttttgttaactttagaaatattctgagatttcctttgtattctgctacactgttattttaggtaatgttctatatgtgtttgaaaaaagtatgtattttcattgtggtgggtgaaaagtcgtatgcatattagatcaaattattaattgcattaaatatattctctatatttttatttatgcgtgcttatatagtctgttgatttcttagaaagttagattatccaactgtaagagtgagtgtgccaatttcctttcatattcttgatttttttcccatttatgtgtttggaagctaaatttttagttccataaaagttaatgtctttcatagtgtttgggtagaagaattttccatgttgtttaaatggaatagctttctttgtcttcatttcctattctttctacaatttctgagccattttatatgtctcttttgactgcatatggctgtatgcttaaatttccaatcagaaagacttgttaggggaattgagaccatccacaatattgtgtttactagtgtatttggacttgctcttggcagcactccttctttattatagtatgtttatggatatgcatataaatatattatgcctgcaatgaactatgaagcattattgcctggcaacatcaaccttagttttagttttattttcctagtagttttctcattttgattaaaaaccacagaatgtcagtggaaagaggggcccctgctctgtgccctgcatttgggcaggctctgcttttgttttgggcaaggagaataacaaatgcttggagcctgagccactgcctcaagcctcctagggcctggtaggcctcttacaggattctcattggccaaatgccaatcagtgagtggatgaccatcctctttagactctattctccccaataattaaactctgtcctaatcaatcactctaaggcatgactgtgggcaggggagagtgaaagtgatgggcagaatttggacttgggactgggtggtccacttaggggtgtattacactacttgccacgcaagttgaagctgagggatgagagtgagaaagtgagatgtcacctccctttttgttcctcttgcacagctctgacgttgggggactgggcacccctcttccagctgccgtgttttggcaggaactctgagaatgcttgaacttaaaactggcattttggatctttacgtagtggtatttccaagtaagaggaatagagcatactttatttaacaactttgatgtcctgacttactacttttaaacactaagatttatgtgggcttccattgttactcttacctcaggccacagacgtcatagaagagcttggaaaaagttaaattcttggggagaatagaatagaatctaaagagggtgatttttgactccagcatctctcaggtttctgtttacccacctgcaccttctcttctggttctgaggcaggtgcttatctctttggagatgtgctgaggcagaatcagatcaacagctcttgcagagaagacgaagtgaggcgaggttgttaggtctagagtgcagaggggccagattagagtagccctggttggtggaagtatcacagctgcaaggataacctgagtttcctgtgggttaagaataggtcatgtaaggtatctgactgaagccatcttgccaggtctcctgtcaacagtggagcattgttgaacagattatgaggggtaagagaaggacatgaccgtgcttttgctggatcttctgtgtcagggacctgaacaaagttttcctgtctcccctgccaccaccagcagagcagtgaagagcaaccaatatgtcctgagggagctgcttttggaggcctgaaacatagaaggaaccaataaccagcatgtgttagaggaacaaaaacaaaaaaacaaaaaacaaaataacagctgtaagtaataagacctgcaaatgcaaatcaatgtcttgttccccctaaaatcaataggtcccctgtgccttccggcacactcacacactgacacaaccacatctggctttcttactggtgtagacaggagggacgagcagggggagcagagagagagagaggaaacaggcttcttgaggcatttctagtctgagctgacatttcattttaaaatggaaaatgatacacaaaaaaatccagcgtgaccagaaaaaattataagcctgatacttgtagttgacaagagtaagttacctttcccgtcaccagttcacctggtgctgataattcagaaagcacatatagtatcaggtactagaaaaagtaaatcattccacatttgcctgttgctaggttgaggcaacttaataatacctgctgatttctctcatgtctggacattttgagtgtgtgtgtgtgtgtgtgtgtgtgtgtgcacatgcacttctgtgtatatctgtgcatgtatttacaaaagtagagtcttgtattccaatgcccgttttaactcaatctcttcatacagatttcattccaacatttgtcacaagatattgcactatttttttttagctgtctatctttactgctagaaggagattttttagaggagactccgatttaaatattgcttctatcatagtgtaagacatatagtagattctcaataaaaacctgtttcttacatttaagctagtgataatgtttgtacctattaagggtgctgaggctattttccaagacccagttggaagatactttaaaagtaacttttctagatcatctgttaatacttctgtagccttttacaggaacagaggaaaagtaaaataggcagtgaggaaggaagtgctgttatttttgtgcatatagcatagtaaatgtgtatgtacctggcatttactggtaaatcaacatgtcagagagatgttatttgttactggctctgtgactaattatccctctagatataatcagtgttaaaggtagtgaagtgcaaaataattgcaacaacaagacctatgattcatttcaaccaggtttatagagtaaaagattctttttcttaactttagcagttttttaattgattctgtaattttacaatggcaaaaaggtagtttgcagtgtaattctctattatttccgtattgcaaattcaatctatgttagatatttgatgccatgggttagcattttttatttgcaaattaagtattttgtgaacccaccatatgttgaatgatatgtagaacagaggcatggagaagccagaaatatttgtgtgtgtgtgtgtgggtgtgtggtgtgtggtgtgtgtgaaaaaaatatgctagaccaaggtatggagagtcagacttccaaaactgcatatctcatctgagtacaatccttctatccaggggagatttaggtttggtggggctcaaacctcatacaatttaggaagcacattttaagaataacaatacaaaattaagaacacaacagtggctgggcgtggtgactcatgcctgtaatcccagcactttgggaggtcaaggcggctggattgcctgatatcaggagttcgagtccagcctggccaacatggtgaaaccctgtctctactaaagatacaaaaattagttgggcatggtggtgggcccctgtaattccagccacttggtaggctgagataggagaatcgcttgaacctgggaggcagaggttgcagtgagctgagattgtgccattgcactccagcctaggcaacaagagcaaacactccgtctaaaaagaaaaaaagaacacaacattaagtattgtgcctatgcaagtgaagagccccgaggcttaagcttcatgcgcttctttgtaaatatttctctttttatatcaagtcagatttgatacttctctctgttggacatgtgggtatgtaatagcttattaaggtgaacagaggtcttggcatatgggtggtatagaagatgttgtaaaggtgaggacgaatttctaagagttgagatgtaaagtattgtttaccactgataaagacttgtatttataatatggaaatttagaaaacagagtgaaaatatctattatttaataagtaatggaaaagatcaactatgatgacagggacttacacttctggcccagttggagtaaaagagaccttctgaatgagacagcaaaaaagtaataaatggacagaatatatgaagcaaaggttttcaagatactgaacatcagacagtgaagtacagtgatcttgaggtaggaaacaaatgaggaaagtcatatgattgtgccagcctactgctttaagacagtttccaacgtgtagcacagggaggagaacccaggtggagcctggtgatcttgaaaaggagataaagctgaaaactgcagggagaccatggtggctagaatgcacaggacaaagtactggagagaagagatttgtctagagaaaagtctcaaaagatctgtaggtagatacattatgacagaagcatagacatgtgatagaagcaatatgtaaagggatgctttgggtatttagtagaggactgcacagcacatgcaggtgaggaaattactaggttttggaaataactacccaaaatggttagtgggaacaatacctgacactcacactgggccagggatagtgcctgttcctacctgtcgactggaaatttcataaccatcaggacattggatagtactcagagtgtcatgccttagttgtggagactaattaggcatagactaacactgtttgaataccacctccaaagttgtaaagcaaaaaataaaggatatagattattttcaagtaatgtaagtacattctatgaaggaaattaaagaatatctataggaatacaaaagtaaatatcaagcatcctacatggtaaaattcacaatgcctagcacccaatcaaaactaaccaagtatgcaaaaaagtggggaaatatgatccatattgagacaaaacatgcatcaagaaaaatccagaacagcgatagcagacaagaacggtaaaatagttattaagactacatatcctatgttcaaaaattaagtacaaagaagacataaaaatataaccaagtcaaatgcctagaaatgaaaaaatactgtttgaaataaaaaatacactagatgagattaatgtcagattagagactacaaaaaagtaagtgaattggaaaataattatttaaaataaagtaatagaaactatcatgaaataaaactaatagaaactatcatgatgaaacacagagaaaaaacaatgaatgggacattagtgatctgtggggcaacttcaaacatcctattataagtgtaattgtaactcttaatgaagagagggaggacagaaaaaaatgaatcaataacggttgatttttttcaaggagctcaatgaaccataagcacaagaaattggaaggaaaccacacaaaggaacatcataatcaaattgtttcaaaccaatgattttaatttaattgcatcattaatacaatgtaatttaatttaattttaaaaaacaatcttttttaacttttaagttcagaggtacaattgcaggtttgttacataggtaaacttgtgtcatggggcttcgttttacagattatttcatacccccaggtattaagcgtagtacccattagttgtttttcctgatcctctccctcctcccacccttcacccctgaaaggccccagtgtgtgttgttcccctctatgtgtctatcatttagcttccacatataggtgagaacatgcagcattttgttttctgttcctgtgctaattgctaaagatagtggcctccagcttcatccatgtccctgcaaaggacatgatctcagttttctaatagttgtataacattccatggtgtatgtgtaccacattttctttatccagtctatcactgatggacatttagacagattccatgttttgctattgtgaatagtgctgaaatgaacatatgcatacatatggctttataatagaatgatttatattcctttgggtatatacccagtaatgggattgttgggtcaaataatatttctggttctaaatcttcgaggagtcgccacagtgtcttccacaatggctgaactaatttacactcctaccaacagtgtaaaagtgttccttttactctgcaaccttgacagcatctgttatttttttgactttttagtaataaccattctgactggtattagatggtatctcattgcagttttgatttgcatttctctcataattagtgatgttgagcttttttgtatatgattgttactgcatatatgtcttcttttgaaaaatgtctgttatgtcctttgcccactttttttatggggttgttttttcttcttttaaatatgtttaagttccttacagatgctagatattagacctttgtcagatgcatagtttgcaaaaattttctcccattctgtaggttgtctgtttattctgttgatagtttcttttgctgtgcagaagctctttagtttaattagatcccatttgtcaatttttgcttgtgttgcaattgcttttggcatcttcctcattaaatttttgtccatgcctgtgtcttgaatgacattgcctaggttgtcttccagagtttgtatagttttgggttttacatttaagtctttaacccgtcttgagttaatttttgtatatggtatatggaaggggtccagttttaatcttgtgcatatggctagccagttatcccagcaccatttattgaataaggtgtcctttccccattgcttgtttttgtcaggtttattgaagatcagatagttgtaggtatgcagtcttatttctggcttctctattctgctccattgatctatgtgtctctttttttaccagtaccatgctgaagaaacaaccttaaaaacaaccagagaaaaaaaagacatattacatacagaggaaaaatacaaggatgacacaagatttttataccgagccaagcttgttatgactgtggcatagtaagccaatcactgagacaacagttttgtcatggagaataagttttagacaaaaagcagagcaacaaagagatgggaaagcagctctaaaatccccctccccgataatggagttatagggctctttatgggataaaggagcaaggtggtccaagacatggggaaaggtgattgagagtaagaaaatatgaagcaattgatgatctgcacaagcatagtcaagcttcatggttcttcataggatgcatattcacaaattatgtcattagcataatctgagagtggagtttttggccctctgacatcaaaaagtcacgcatctatactcacacaggcccatttggagggtcagtggtctcagtggcttgaactggatgagaactaactctaagttcctgaaaaacaacttaagtaattgttaccatggtgacatatatattagagacattatgtataaggaagctagtgggagtttagttaaacttgtttagccacctgacttttagctacataacgtcttaaaatcaactgaaagcaagtgactaaaacaaggcagagtaagttaagttgggcaggcctaatctggtaagccttcagttttagtatcttattggaaacaatgagaaatcattggagcacggtcttgtggacatatagctctacacacagcaatgaagaacactggaaaggctttgaaaaaaaaaagaaaaacataaaatacaatgaaaatataaaacttgttttatccaaggtgccagtatctctactgtttgcctactgcaatgccaggatctcagagacaaataaaaaatgtgatagaaacaatcccctatatcagtagttgagaggacaatgcaaacaaatacatcagagaatattatatgagctcatacaattgtgtaacatctatctatctatctatctatctatctatctatctatctatctatctatctatctatctattcatccatccatccatcccatggtaatgcatgacatttatcatggcaggtgtctcagtctgggttttcccagaattatatcctaagatgagggttagagtgcaagtaaatcacttgggaagtgattcctggaagcaccagcaacgagtgggaaagtgagatggggaaaagggaaaggcaggccacaaattaaagtatcattatcaagaagataaacactgtgtgcaactagagtctaatcacaccaggaaattgtggatcagtgtacagcagtggcctcaggtggaacttactcttgcagagagaatcatggccttccaaagacaaccatgccctaatctccagagcctaagactatgttatgttacatgtcaagggaaaattaagatttcacatgtatttaaggtcactaatcagctggccttaagataaagagaatatcttgcattatccaagtgctcccaatataatcacaagggtcttttaaatgaggaagaagaaaacagatggtgaaattcagagatagatttgaagctgtggctggcttggaaggaagggggctataagctgagaaacagaggaggcctctagagctggaaaggacaaggaaacagaatcttttcttgagatttcagaaggaatttaactctgttacaacctgattttagcccaattagacacattttagatttaataccttcagaaatataagatatttgtattgttttaatttaccactaagtttatgttaatcccttacattagtaatagtaaactaatatacccacttgaggggtgaggtagttgggtatttataacacataccattggttggtaattgcttctgtatgtggaaagaaagtggcccccaaaagagagagaaagccctttggttgctggaggttagctaataggcactataaaggtaaggcctgctggaatgtgggcactgcacttactagtaaaataggctggcctccctcttcctgtcctttccaccccttcttcattcatctaacatttctcgagcttttattatgtaacagactttatgctagatgctggaaatagaaagacactgtatacatttctagcctagaaggttcaacaaagaggaaaatgtttacatttcctagattctcagttctagactctaggatagattgctgagatatttttcatcaatggaaagaaacacatttttgttgggtttttcaaagaacgtgacatgacacaccatttttacaagggataattttagtgcagaataaaatagagcagataaactgtcacccaaatgaagaaatgccacatttattgttctaaggcgtccagagcaagatatctttttggtatgaatgtgcaattctacacacaattatttctttcttggatgtgagctaatttctattggacattaaattctataggaaggtgaagattagtctatctggatgcctgtttgtttttaatgaagatgttacacaaaataaaaatgaagagcatctgataaacttgtatacaaacactcacacacaaatcttctttaggcatatctcaaggtatttttccttcctcataatgtgctatttacacttgactcataataccagtttctaggtatttcagaatacccagaagtttagcacaaatacaacaatggttatgctacagtggaaatgaagtaagcaatagatgctactgcagtaatttttgaaatttctttgttcttataaatggtcaggcactgcattaaaatttggaagattgcacacttgcagcctctggtgacttcccagattgaatgaggtattgcctccctcatactcttgtaacaatctttagacctgtatttctcccttccatgttgtagggtagctatttatttaatgtctgtctactgcagtaagccgtgtgtgctcctgaaagctgggttttgataatcttattgttctttctctggcatctagatcatgcttgacatatgttaaattctttaaaaatattcaccaaatcagtgggcaaaagaagttgacaaactcaagcaatgtatttcgtatttattattttataggcttaaagtagacaattttgttctgtgttggctgagttaatcacttgtgaaaaacagcaaaattatattgaatttcaaacacatgataaccttctgttgtattgagctaatcaatgggtgtgtttatcttctttttactagtaccatggtttactgtgttttccaaaatactctttgtcattaattaaaacaaaccacattatggtaccatataatctattttctaaatgaaaacactctgtggttttgaaagttcgtttctggtccacaaacaaataatttcatgctcttatcctcatactatttgagtcttagtttttccatttatacaatggagaaagtaaaaatagaaatgcagttttttatttcagagagttattatgaggatcaaataagctggaggacatcaaagcaaatagtatatcatcttttcttttactttttattttttatttatacctaataattgtacattttgtggggcacatagtgatgttttgatgttttgatacatgtattgtatcagatcagggcaattagtattttcgtcatctcaaacatttgttatttctttctgttggaaactttaaatatcctccttctagctatttgaagctatatattatcattaagtacagtcatcctatagtgctatagaatgctagaactttttcctcttatgtagctgtaattgtgtattatttaacaaatctctccctatccctctgttccccttacccctcccagcctctagtatcatctgtattaagaaaatacggatatatggatgagaggacaacaggttatagattttgatagtgggatatcttaaagggaaggaactagttaattatccataaattccttcaatggtgtgaatattgccctttattatggcataattcttaaaatttatgctattgctttgagaagcacatcgaagagccatgccaaaccattctataactttcaggaccttggacagcttctttgcttcaagatagccaagaggttaaggcaaagacaacccaacagggcaaatttttttttctgaaaaagaaagtttgtttttaacccacactgtagcgttgtttatagcctcctcccagttcatccttgaatccatagtatatttctctatacatactcctggataagaagaaacaaataataggaagataaagttaggtattgtcatcagagcattaacacagtgatcttattttcgtaaactcttaatatcatatatatatatatttgcatctttcttttttctttcttttgtttttagagatagggtcttgctgtgttgcctaggtttgtctcaaactgctggcctcaagtgatcctcttgcctcagtctccaaaaacattgggattataggtatgagccaccatgcctggcccagcatcttatgttttgtagcatctagccataatgtatttttaaaaatttcctggccgggcgtggtggctcatgcctgtaatcccagcactttgggaggccgaggtgggcggatcacaaggtcaagagatcaagaccatcctggccaacatgatgaaaccccgtctctattaaaagtacaaaaattagctgggcgtagtggcgcacgcctgtagtcccagctacttgggaggctgaggcaggagaatcgcttgaacctgggaggcagaggttgcagtgagccgggattgtgccactgcactccagcctggcgacagggcgggactccgtctcaaaaaaaaaaaaaaaaaaaaaaaaatttcctgtctgtctgaattcaggaaccccaggtaactttgtgtcaatgttatctctgatttcctccacagagtctctatgggaaatattgtagaggttatggcttccaccctaacaataatataacataaaaggaaattctaaaatcttgctcatatctaatgggagcatttttgggaggcattgtgcacacattgctagagagctatgaaggaactgtttcaaatgaagagaaatgcaagcctaggcagtatgaaatgtatcttggtaacagccctctgtcctgtaatttatcccacctagttttctttttgtttagattgtcccacttaatttccttttgtttagattgttggtttttattttcagcaatgtcaaatgtaggtagtaatttgatttataataagagcttacatccaaatgttttgatagcagagtcaaaagaaatacaacctgagccatccccagggagtcatatacatacggactcacatgcatgcacaaacacacacaggagccacatttgcaactgcattacggatttacaaaattacttgtatttcattcaagaccgctctaatgggttttaccagatcagaagtgaaaattttaaataaattaatagacagtttaacccaggttatagtcagtcactcaggcaatcagtctagctttgtctgtgtattttacaaactggccacccaagttcagagtgaatataggaacaaaaaatcaagaagaccacaggtaaacataggccaaagggttaaccaaccagcccttactaaaaaagttagtcgtcatcattttgccccacttcctcatcgcctttcatggtgtttcacaaattttataggtaaatgagtaaggatgtgatctcattcacttatctattccgtttgaatataaaacattttgtttccttcccaaatctttaattgtatcttgataaagaattcaagcttctttgtactttgtaggagttggagatttttttttttttggttgatcatgaattattgaagttcagtggactggaattggaacacttggatcggagattttattctgccaattattacatgtgtaaatttgggcaagttagctaactttagaaacagtcgtcttgtcagttaatgagggtattattatatctgtaatgcctttcatcacacatggcttttgggggagtcagataataagagtaaaagtaacttataaactgaacaaataaaaaagacaatgatttaccaactacttccaacattactatttaaaccatgactttgagatgctatattttaagaatgaaaaagaaagtaatctttattttaaggagaggggcaaggcaataattttccataagagggcacagacactatatacaaaatggaatctgtctcagttttcagaattttcatttgctagctcgagtgcaagctgcttgtgttagtttgcgaggacttccatacaaaatatcatataataggtgctttaaataacggaaatttcttttctcacaattctggaggctagaagttcaagagcaagttgttggaagatgtagtttcttctgaggacctctggcttggcctgcagatggccaccttcttgctgtgtcctcacatgatcttttcttttgtgcacacacatctctggcatgtttttgtgtgtccatatttcttataaagacattagtctcattggattaggacccactctaaggacttcattttaagttaatcacctcttgctcttgctctaaatacagtcacattctgagttatggatggttggggcttcaatgtatgcatgaagggagcataaatccgtaacgtttgacttttggatctccaaaatccctgtccttctcatatgcaaaatacattcaccctaatcccaacagtccaaaatctttaccgatttcagcatcaattctaacttccaaaactcatgtaaatattatctaaatcaagtatgatgagagacttgaggtatgattcatcctgaagcagaatttcactccagctgtgaacttgtaaaattgtacaagttccgtatattgaaaatccattgctaagacaggaatgggatgaaaattctcattccaaaaggaataaatatgaaagaagaaaggaatcatagatccctagcaagtttcaaatgtaacagactaaattctattagatattaaggctcagtagtaatcctgtttggcttaatgccctgcgctccaggcccactggggtggtggctctgctttgtgggtccaccgggacagcaatgttgccttagccctgggaaatagcgtcgtcttctgatgccttgagtgacagtcctgtctctatcatcctgggaagtggcagcctggtccactgaagctaaggaggtgcccctcattctgaaatcaagaaagagacagccttggctttccatcctcccaccagacctgggcccatggtgagagtggcagtcccgccaatctctgaatagcttctggggtcattctttcatttccttgatgatggataacatatgtttacagccatttaacttgattaaatggatattgaattctcccatcctgtagaattctggtattccaatagcctttctttatttggggctatgtctgtcccctttagtccaagccgacagtgttttctgctgatataagcccatatttattcctggcttctgctgagataagtgattagatctatgagtcacatccataatttctttatggagtaattgtccagctacattcttggttttctttccaaaacataccttttattttttttcaataggaataagctgataattattcaaatattcaagttctggttgctttttgcttaacaatttcttcttcaataatctctttcctcttgcagtttactataagcagtaaggagaaactagactgtaccttcaacactttgctcagaaattatttcagctgaatacccaggtttgtcacctacaatttctactttccacaaaacactgggacacagttcagctaatctctctgccattttatggtaagtgttgtctttcctctagtgtcaaaaaatatatttctaattttcacctgaggccacaacagaagcaagcacatttaatgtccatgattttacagaaagtttgttcaaggcaatctaagcttcctctaatctgtgcctcaaacctctcacagcctctactcattacttctaaagctgcttccacatttttaggtgttcagttctttagcatcccacatcgtggtaccaaaatctgtattagttttctggggctgccataacaaaataccacagacaacaaaaatgtattttctcatggttaggagactagaaattcagtatcaagtttcagcaagcctgagcctctcttcttggcttgcagatggccatcttctgtctctgttcccacgtgatctttcctttgcacctgagcatccatggcagttcttttttgtctacaaaatttcttcttcttacaagaacaccggtaagtttggattagggcccaccctaagagcctcatttttacttaatcacctctttagaggacctgtctccaaatacagtcacattctgagattctgggagttagcgtttcaacatatgattttggaaagacagtttcgtaacttaacaataaatgaacaatttgagcttaacataatgatgaattttgacttaggaagaagcatagctttagcccatgtaacactgttgtatatcatcactgtgaaaggactggcatcttagtgattttaaaaccatgtttccctgagtctcgggcagtgagtcaggagggctatgtagactgtgtccatggttaggtggagatgctgatgggtttcggctctcagacctgttggacacagatgtaccataccaggggaaagtgctaaattgcttgtaaattcactggcactccaatactctatccatgtctggaaataaatgaacatagagtctgtgatcatattaactgaaccacacatttggctaggaatatcagatgataaaactgagtaattaaaataaaaattgttctaggatacctggaatgcacagcaattgctccttttcttaaatgttgatggccttacgcaatggtgttcacagcacacccctctttatcttggggatgctttctctgatggatgggcttcaaaattgctaatacacgaattactcatatttagacatttgttcttttaggtgccagactgttttcttttggaatgtatttttgtgtgatgcaatttgtcacctagatcttagcattaacttttaaaggatgaatgttgatatattggttctctttttttataatttcttgtatgacaaagtaattactacctactgtgttctaggcaccacactaagtgctattaatgtagccgtgaatttacgttgtcttcaccaagggtatcataatctaatttaaagtattttttcctcttgtagaaataccttcttccatgtataaaggcacctaaaatgttgtacagctcaattaagcttagtatctttcttgttttactcaatctcagtttataactgttgtagattaaataatggcccttcaaatatgtccacatcctgatccccaaaacttgtgaatgtttccttttaatgctaaaacaatttaaatatgtgattaaggatcttgatatcgggagattatcctggatcatcctggtgaactgctataatcacagttgtttttatgaaaataaataaagaaggttcaaagaagaagagaaggtggcaaggtgataatggaagcagagataggaatgagtcactttgaaaaaggtggaggaccccaagctaaggaatataggcagccactaaaaagcagggaaagagtctcccttcaaagtccccagaaagaatcaaccttgctggtaccatgacattaactcagagagaccatttttgaacttctgacctccagaattgcaagataataaaattttgttattttaagccactgaaggttgtggtactttgtcatagcagcaacaggaaactaatagaatcacattaataatcaccagtacactcaaaatcatttatctacattcttctttacaatctgctcccacatactattaccactgttattaatttatccatcttaattgtaatccttccttccgtatttgcatcatgctcttaatttagaaacttgacattccacttgaaatcttatggtcagtttccaaatggtatctctgttttcagcctcactccttccaaacttttctccagattgtttccaaaattttctcataaaagccaaatacgaacttttttcttcttaaaatcctgtgatacctcatgagcttctgtcctgtttgccaaactcctattcactcgtcaagaggcagtttaaatatcttcttttctgtgactctttccacagacataaatgtttgcattatcttctatgtttcaaaggcatcttgaatatattttcttgaaaaatccttttatatctatcgagacagatagatatagagatagatgcattccagggcagcctgttttattactatacatatacaaaaagactcaaaaggataagtaataaaatgtattaactgcaaattccttctggaggtaacattataaaatatgtgctaataacaggagaaaagaaacagtgaaaaaatacaaaacggtgttttcaaaatatgtttttcataaatagcaaaggctttagaggagatatgttacaatgcccagaaaacacaaaggaaacacagtatgcaaagatttacacatgtatgtagacatatcagggaagggaccagagaacaggaagataaatacaataatagttaacatccattgtgtgctttccatgagccaatactgttctaagggttttcatgttaattcactaaacaatccttcgagacaagtgttgttaataaccacttttaaagttgttatggagactgagcacaacattaatacaactaggaagggatttgaactcagaaagtctgtttccagagcttgttttcatatccaatatgctttaccatctcagctggaaggttttccactgctgctggatgggcttttctgaaagtgacctaggccaagccatgacggccaaagtggcccaagctcatcttcagagatgttcactggatggtggtgttcttatttttcaactccaaactcagcctgtaattctcaccaatttcaaatctgcaatcacttaagtctataatcgctatcaatgatatttctaacacatcccagcaattcttaaaaatgtctctccttattgtaagaactcctaattccacgagtgattattaatgcagggagagagatgagaagttacctttggggatataattgaaaagtgagtaggaagcaggcagaggaagatgaagtaatgacagagattgtgttgtgagtaacgcagatactttcaataggatatgcccaagttttaagtgtgtgaattttcaatgcttctctttatcctccattgtgtcatatagcatgaatcacccacatgagtgggtcatcaaatcaattttgtgggtcacaattagcctttgataaaggaaaataacatagaatggaacagaagagcataatatataccataacatagcgtaggtatatttgcataaatctgtatcagtcatttcacactttgcaaaaattactgcaacaagtggtaagtcacagtgccagagagccaattagtagagggagtacactgaagatgcccactgggtagaatggcttgttttgtctttttaaaattaacttcttatttgattttttggcctgggagaatcactttgatcatcactgtaaagaaagggcacagtttattttatattaacataattattagttaattgtgagatgaagccaggaattatttttctatcatgaataaaagtattgagattttcagtcaagtttcaggctgcaaaattaggctgtttttcagaaagaacattaccaaatttgtaactgtaacattctagtaaatttaatactagtacccttaaaattaactgatatattattaaaaagaaaaaattatgaatttaaaaatgtaaaggtatgttttagttcaactgaaggatttcaaaatgtaaatagtgaaaacattgagaaaaatattgacaaaggagcaacactgtcaatttcaggcaaaagtttaaaatgaaaaatttagtacaaatcatgaaacctaagacactcaaaatcattttaatcaaatatgaaaaatccagtgaaaatgacgcctgtgtttatgtaatgatattttgcaaataaaaccttaaaactttcaaaattaaaatgatacttggaaataaaggttattgtacttaccatgtcttttaattatttgtaaggaagggaaaatataaattcattggcacaatgtcttattcatttgaattttttattttattttaatttttttgaggcagtcttgctctgtcacccagacgagagcacagtggcatgatcattgccatcttgatctactgggctaaagtgatcctcctgcctcagccttctgactacaggtgcatgccaccattcccagctaattttattttattttataatttgtagagacaagtactcattacatttcccaggctgaacttgaactcctgaacttaagtaatcctcccaccttggcctcccaaagtgctgggattccacaacctttaatataaaatttctactattgcatagttacagcatcattgtgtgtttaaaaaaatagcacatataactttgaaaactatattaccctgtatagatgccatagtgtgtgtgtgtgcatttttttttttctgagagggagtcttgctctgctagctcttgttgcctaggctggagtgcagtgacgcgatctcggctcacagcaacctctgcctcccaggttcaagcaattctgcctcagcctcccaagtagttgggactacaggcgcacgccaccacacccggataatttttgtatttttagtagagacctggtttcgccttgttggccaggctggtctcgaactcctgacctcaggtgatccgcctgcttcagcctcccaaagttctgggatgacaggcgtgagccaccatgcctggcctatttttaagaacaaattatctgacagaaataaaacctttattttttgacacgatatcccattttgtaacttttagaaacaatgactgctatattgatacaatccagtataaataagcaaatcaacctgatgtgagaaatgacagtcaagagtgtgtaaaaatgctagctaatggcaaatggcaaaatggcttttggagggtatgtaatgtagttaaaatttgattaaatgttctttggaattggataagagcatcgttgatcaatatgaatgacactggtaaaatgatatatgagttacaattgagagagcaaaatatgtgactaggaaattatcagaagctactaataataagctctttgaagtcacttgttaaatttatcttagagctttgatatccaaagaaatttagctgccttttatggatggggaaagtaagtgaaaaatgtttgttttattaaaggaagctcactgaaatgtttttgatatatttcgtccagagattggtgctatgcatatccatattttctaccatcctagcattcttagattgtcatgaccaacaatactgagcaaaggtaagaatcaagatacaagattcactttttggttattgttggagaataatcttgtatagtaagtaatttctaagataatatttgggttaaaatggcagatttaataaactaggaaaacaaagaaaaaaccaaaatgcatttcaatatattgaccttatccaaaggtgatagtgtagtgttttgatatttaatttacagaaatgctctgaaataactattgccatcctgctttcttaagtaaatggtctagaggtcgtaggagttagcccagctccactaccatggagcaagttaatttgtagagataagatttgaactcagttcaaataaggctctgaaagctatgttaaggcctctcactgccctccctctgtaagtaagaaatgtgaggaaaccaagatttactcattaagcatgcccggctttgatatattttcccagattagaggaacagatggctcttagtggtggtttttgttgttttcatggttattgttattattattgctaatgcctacctattttccctatcaaatgaatcaggaagctttgtccagtccctcttaattaaatgcagtgagagaaatgggatatcaatccaatacattgagctcagcttgtcctgagagtcagggtgcctagagaatatttgatatgccatgagttgcacagtgttataatgggccctgagttagtgttttgtgtatagtattcgtggtagagtcctgtctcttcccagataagtgtgtgttatataggatataacagtaagtagacataagtgcttgtttttattattagaaggctgataaggagcagagaacttgtggtcttagcagcccacattaaggaatgcaggttctatttaagtgcaatgataaatcaatgatggatttccaaacccggatgtacttttttttttttttgaggaaaagaaaaacctttgttgatgcataaggaaaggctgggtagaagaacagagttaagggtgggaggccagttaggagactgttgaagtaacgcaagtgaggcattatagtggaatggactagggtggttagagcagaaatgaaattacactctctgtatattgcagaggtagaattaatcaaataggacatctgaatatattagatggggtgagggaaaatggactaatcaaagacaacccttatttctggctataggaataggatattgtcattaactacattgggagacttcgagtacggagagtttttttggattgtggaaaattaagggttctgttgggagatgcacattagaaaactaagtgaacttgctaagtatacagttggagattaaagcaaaagagttatcagtctatagatagttagagttagtgtgtagacatctagtataagatcacctaggaaaagatatagatggtgaagaaaagaggacccagtcgcataccttaaagtacattgacattaagaaactcgacagagaaagaagaaatagcaaagaaacgcaaaagtgactgtgatgcagagatagaatcaaggagagatttgaggtttacttactatattaaatgtggagaatttgaagatgaatctaaaaaatatttgtctgttttctccgagggaatatttttatggttcatttataaagtcatctgtattgttttatgtgacaaaactggtttcattggttctttagattacttactgtcatttttggatttgaggtcataggagcccagaggggcaaaactctcagtaggaagcatcagtcgtgtcaatactgctgtgaggctgagtagaaagatgagaagtgagaactttttcttttggtgaccaacaagttattgatggccttgagaaaaatgcgactctggagatgtgtctgcagaagctggactgtagttggtgaaaaaatggacaggaaatgaaaaaatggaaaaaaaatctgtccagaaggttgactatgaagaggagcagagaaatgaagtataaattaggagaaggctaattgttcagggggcaaattttttacagtaggaatattatagatcatgtatgaaacttaagggactgatgctggagaaagtttgaagaggcaaaatatgcaaagaggaatgtttggatggtccttgagaaggtgtttgcgacagagtttgtagtctaagaagtgattgtccgtatctttactctttagatctcaatgttctcatctgtaaaacggtggagtagctgtggattatttccaagcttctttgtgacttgaatattctacaaatttattactgttagtcatgcatatgctagtaagcagtgatgaacatgggagatgtatcctgaggctgtttactctcatattaaaagtggagaatttgaagataaatctaaaagatacttaagtctattttctccaagggaatatttttatggttcatttatgaagtcatctgtattttatgtgagaaaactggtttcattgttctttagattacttatcctcttgtagaaactgtaactattttgaagtttgaggctgcaacatattcacattggtttcactgttttaatcttattttcactgcttttgccatctaaccataagatattggtgcagtaaggataattaagtaagataagtttattaacagcagcaagtatcttgaagacatacccatttcagatgtatgttaatgaccatattttttactctactatgctggaaggttttcgatggaattcccggaaaagagacttatagcagccatataaataacaattacagagagtattattggtatttatgctgaaatgccttttatattgtctttaatacttgagtagaacttaattgaattatatttgtcaaggtaactttttcctcttaagaaaaatcccgttgcttaaaattaaaaaaaataaacctagtattttctacctactagtaaaatgcaagtttacatattaaactcttgctttgcaaatgttaaattggttgaaatgagtcaaattggcaatttgtttgtaactagaatgtgtgtgagaagctgagtcaaaaatttgagaagcctccattgcccttttcaacttacatggtacttatttatgcaaaaggaaggcacatcaggtatgtcgtgacatgggctgaaacctatgtccatagaaccaggaagagttgggcatgggatatagctggttgatggaaactttcaagctgatatttcagtgttaattattgtcttcaatatgtacattgtttccaagaatcatattttgctttatcaaatggatgcattattatattttgttaatatctctgatccttttttgttcagaaaatggttattatctcaaaaatcataggatttgagaaagattacatgatataacaagtataaattgtagatcatagaacttggcacctagtaagcactctgcctcagcactcatgctcaaagtctgttaatgagatctgaatctggtggttttacagggtacaaaaccacaatgatttgtgaatatgtgagtctatggtagaatattaatgtggaaataatctggagtgcatacactgtgtgggtcccccaaaggcatgggtgattgtaggcataattaaccaaccttccttactcagaaagtggaaatggcaagttagagttttctaaaatataaaagcctatttaccagttctgtgatgagattttttttaaaaatccacacaaaaacaaaacaaaatgaaaaccacacatgatttagcttgtttggattgctatttgatgatatttaataataatagaaataattacctctgaacaaagttaattcagtatacattttgctattacttttctcttaagtaaaataatatctatcacccatgaatattttaaagaggtagctctttattctccagagtaaactatgtaaattcccaagaaccaataatttccataattattaaacaaatattatatcatagtttctgagcattagtcacagaaaaactcctgagattagattgagacaaagtgtcatgctttacgtttttactttacttggctaggattctcttattagaaacatacctattgtattattattttcaagcaaagaaaacaaaattccattgtaagttgggtcctttcacacttaatataagcaaaaactgtcattttttcattactgtaagctgattgaaaattgaaactgtgaacaatgtagctgttccaaataatagtttaaaaaataaaattatttttttctttgaatatatattttatttatcagaactcactaaaggattatatgtggaaagaatgttggtttataatttagaaacaacattttttagagatatttgcatttgcaacataatggaagttgatctcatagttgtaattgtcaataactgtctgctgtgcttgagactatatctgcccttgctcatttctcactctgcactcctggggaagtggaagaacattggccatgtctccttttgctgggcataagaaacatatataaatagatacgttataaatagatagtttcaagtaaataatgtgttctcttaagctcacaatgatgacttttataataaataatttctaccataacaaatgatttctttgcattattgcaaatacagatttcagcaataactgttttaggttccttttctaacactgtggatgagctagaatgactctctttgtcctctccttcagaggtctctcctgtcacctcctctttttctgtcttcccatttagcttaggggtctccattctataggctctctcacaccattgtcacagctgcactgtgatccaatatagacattctctgtatgatagcaactcctattgagtgccagcagatacaagtcctgcaagatgcccaaagaataaaagagatctatggtcaatagtgtagccatcttacagggtcaggattccattcatatattaaagtctttgtgagacttgcagtaatgaaacctgtgattaatctatacttccctaaattactttatcatgtgttttagaatagatatttctagtctgagaacctagttatattggaatagtttgggaaatgtcatgttactatttgaacgataagaagttatctcttcatttagaagaggtaacctagactaagaatgattgatatcacccatcagatttcatctgcttaatttttcagttctgtgcatttaacaatagaaagtttaaaacgagccatccttcaatgtgtttagcattataataaaagaacataggaaagatatagtctactgttctcattttacagttgttgaaactaaagcctagagagaggatattagttgaccatgagcacacagcttagtttaaagtagctgagatgtgagttgttttttgttttattttctttttgagacagggtcttgctctctcacccaggctggagtgcagaggtgtgatcatagctcactgtaacctcaaactcctgggttcaaatgatcctcctgccttagcctcctgagtaggtgggcctacagatgcatgccaccacaaccagctaatttaatttttttttgtagagatggggtcttgttaggttgctcagcttggccttgaactcctggcctcaactgatcctcccaccatgtcctcacaaagaggtggaattacaggcataaaccatgcacccagtcaagattgtgatccaaattcttattttccaattccaaatttagtgtcaagtctacaagttcaaactactttcattaaaagagaaccatagttacaataatcttgatagaacccacagctttttgtaaatggttttatttgtagtaatatttttctgtttgtaatatgtttctcgtgaatcacatagaagcgcagaagcattgagaaagcccatgaagctgggtttttgtacatttgtgcatatagcagattgaacccctcttttgctatttaatatagtgtgaagatttccccagtgctgtacttactttccaaaaacatgattgtttctttagacaatttcctattgttgtttccaaagttttgctatttaaaactgtattttaccaaacgtacgaaaaatgtaattgctgggtcaaagaataacaccatttctagggtttttctctgtaatgacaaattacactctaaagtgttatcagtttcattcctctcagtagtgtatgagaagacacttgtttattttttacaatcaaacatagtatcttcaaattgtccagaattctgagattactttctttactgttgactatgtaaaatagtaacttaaaatgctttttatgcctcttggatttctccctaatgtccctatttctgttgataataatgaagttttctatttatgatttaaattgccattattatatataaaacatctgtttgaaagtttaaataagatattgtgttaagctgaaaggtaatatttaaaaaaatcattgagcatttaccgtatttaacaaggttcccagtttatcctctcttcttttaaacctgactttctagtacttgagattttctttattctttcctggttaggttaagtatgcctttaactgcttttttttttccttgcataaaggatagatagcatgtcgaatagttggaaagaatttgtatatgagataatagctttctattgctcctatacattgtcaagtgatcaagaatatgctgggtgctcattcttggttcgtagttttctttttctcaaaagagtggagtattttcattttcattattttttggtgtctgattatatagaagtcaaatttgaagcaagtccaatttgatcaagttcttttaacttaatttttggatacttgtagaattttttaaatcttgaaaaattattgccattattttaataggatttactttttgtttcttcataaatctatttttatggtagctcttgagttctaaaacgtcagttttctttagctgaggaaagttatttttcatttttttctatggtaactgcacttgttccattttgctgtctttttcagatttctttcttatgtgaatttggtctctcagatatgtttttcgtatctcccactcacaacattttgtcttgatcctgctgaatggagctcaagatgaattcctgcagttttctctttcatttggctttgctaataatttaacttagtgtttttgatttaacccttggtgttttccatccaatgcaagcatttcatcttcatgtttacgtttcatatttcatagaagcaatatgattatatgatgaatgccaataaatatttagttattatagtatacaagagataaaggaaggtaacaccaaaatgtttttcctacaattgtttcaaaaatctattttcttgactgtccctgctttcctgcacttcttctcgtaggttcactgattttcctgtttgctcacttggtttcatgcatgttgtggccggaatgcatgtttactatggaatgcatctctccactgtgtttggcagcaactcgaaaccccttcatttagcttttatgctggctgtggctgtctattctgagggaagacttaaggggaagccctgaaactatcttttctgcttcttgtgattacttactgatggaaaaggctcccttgatttaacttgtgttggctgttcctggtactggcctttgccttacagtttaaggatgctgttgaatattaacatattctttcaattacttcctatgagtgtctggagataggaagtagttgaatgttggggtgaatgatagaccacccacttctgcagggttccttgtgggtcttcaatattctagtcctacagaattccttgtactttctggttcttcatcagtaccttttctagatacagaccttgatattgtttgttttgttttgttttgtttgtttgttttgttttttgttaaattggtcaatgccatgcaactgtggtcagagggactgaaattgttttcacatggctctcttcactggaaagccctgggttaatctgctcatgatcctttacatccagctctggaatttttttttctttataatgcataatgaatagctttgctaaagaggattctgctttcaaatttcaagaataaaaagaggacatctgtctgagtattaacatgatggaaatttttaaaaatatcacatagtgtgttagctcatatgtgacaaatagataatgcatctcatggccattaggaacagaatatttgtcagaacattctgtctattgtttaaaggcattggtgtaatgtcataatatttctacaaggtatgaaaatgttgcactgtgcatgtctgaagtctatagtgtatcccttagactcttgccatttagctgaattctgggggaatgttgccagtatcgttgtttcaaatgagataatcaaatggcttatggagctctatttacccccattccaccctctgtcacaatatagtaagttacttattggagcatatgcttaatgaaaaattaatagcaatgcaatatgatataatggtgcaggactatattctgactagtataagatatttacatatttttgccaattggtcattatcttttatttcacatatccatgatgagtgcatatttagaaaatgagagagtgctttctgctaatgtttctgattattagtgatagtgctgaattcatatgcttacagagagactgagagggagaagaagaggggctagaggaaggaggaggcaggagagaaaagaaagggagagagaaaggagggagaggaggaataagagtgagaatgtgaattgctgtgtgggtgggcctgtgtatatgcaacacagatgcataattttggaagtctgcattttctatatcatcattttggaaccttaccaagtagtgcaaatgctgtgatttagttgaaactaattatgggtacctctaaaatggtatctcacataaatgtctcataggcatgatttgaaaaaaaaataatttgttattattcttccttgaaagtcatgtatttaaattctttaataaaatgggtaaggtttctgtgactagccaagataaggctgcttacacttatgaatctataagagactatacatttcctcactcttgcatgctattaccagatgaatcattctattttgtatctggcgactcattcatctgctaagagaccttctgggccccacagtgcctgcagtgcacatggaagctctttaggctgacattcagggtctcctgtgatatggtgcctctctaacactgtatcgcagttgacagtttgtgtgtgctttggcctccagctaagtcaagccccttgccattctgagttatgactgtgggatttctgccctccgtgcctgtgcagggtcactatgggatgtccttcgcctccagccttctatgtctagatgctgtgcatctttacacactcagctcagatgccttctcctccaggaatggtcaccgctgaggcatcatagttgttctccttttaacatgtaaactgatggaagcctttaccttcatgtctcctaagacagtgaaatgtgaagcctcagctatgtatttggagggccccgaattccaattagcccagttatgttgtctttggtatgacacctaatatctcggaggctccgtttcttcatctgtgaaataggggtgataatatgcatgtcacagggcttgggaaaatgaagatgatgtctgagtcatgtgtagcacagtgcttggaccataatcaatgtcagataagcgcagcatactctatgatttttattaagtgccattgctctctcctataatgtgatttatttgtacgtaatgtctccctagctgtggggtccctcatatttgtctatatgtctgccccccaccccccaccaaaggcccaacttttttttttttttacctcaaatatgcacaaaattgagtctttattttagtactcagaagacagtgtaattccagcccagtttcttccattatttccagtacctctgagctgagcaggtctgggtgatttgtgagtcttcatgtgtgataatgtgtagcctctacttcaactgtcttctaggtggcaagaacttctggcttccttccctgaagagaccagctgaagtttgaagctccgcactctcaaagagcttgacagttgcaaggatattttcagtgtgataaagggcgtagtttccattggctgattttaagaagtaatacacatggaatgtgattaaacttgtgtcttctgcttatcaaacaggtggacttttaagctaatctagagagttgagctggttagcatttatctacatttaatcagatctaatgttggatagttctacttagacatgtttctctatatgactctagacattccctcctgtggctagaaatcaacctctttataatcctgcctcccaaactggccactctgattctaggaactttgtggtatgctgttgtcttcatgtcctcaattctccacactgctgtgtagtgtggaccagtggacatctcatgggtctttggagtcagacaaactgggccgcagagtcgatgttgatattactgaacacttctcagtcacaatgtcctcatctgggtaaataaggctaatattgtctactgctaggactgttgtaaaggaataaatgatgcacaagtgttatgtgataaaacaacgtgtgtgatagatagaggacccaatgaatgttaatcatctcctctatgctttctctccttttctcacaactaaacatcatgagaaataagtctagccaaaaggataagcatatatcttaagtagggcttcccttttacctgtaaacatcctcactttttaaaaaacatagcatgaaaactttgtgtgtgtgtgtctgttgcccaggctggagtgcagtggtttgatcttggctcactgcaaccttcgcctcccaggttccactgattctcctgtctcagcctctcaagtagctgggattacaggcgcccactgatttttgtattttaatagagatggggtttcaccgtgttggtcaggttgatctcaagctcctggcctcaagtgatctgcctgcctcagcctcccaaaatgttgggtttataggcgtgagccacggtgcctgggcggcaaagtgtttttaaagagaaatacctttttagattccaaaaatatttactacttgaatgattattgacagtaaacagccatcatttacgtgaaaggtaaaacatgtgctttattttattttttaaaacatgttcttacgagacctcaaggctcaactgacacttttttaaaagagacagtagaaattgaagaaaacgataaaatttaagaagaacgatttctaaaacttatcccaaaatcattgaaagaagtacgttggtgttttcaactaagttattttgaagaattgagatcattctagacaatcacagtcttggccacatgagcagttaaaattaatacaacatggctatgataatgacattttattatattaattacagtgaaaatgtattgttcaagaaaatattttctctaggagaggtcaggtcattttgtaaaaaatgttcaagtttgtaatgagactacataacttcttatgtttgtttctttgggagtcgtaacaaaaccttaagaaatgagatcttcattacaaatagattcatatgtgctcataagaaatcaatttcctttatgcctttaacaactagcagatgagaataaaatggaataaaactatggttatgctttaaagtactggcaatagttttaacaaatgagacttcatttacgtcttcaatatatgtatattgttaatttattatctctaagtaacacagaaattcatgtgagtccagtgtagtgggagctgagacacagggagtataaactgaatccagacacttgcttcagtcaagtatttttagatagttgccttagtcacatgatccttgtctggacagtattaacttcctttgctgatatctattctaaatgatacattttgggaacataatcatgcctaacccagcagtgaaaccctatccaaacatatcagtttgaaaattggtaaggaagatgctggataataaaatgtagatatattttagttcctaatgagctaagttatgtttctggttgtgttttacaaattattcataattaccctttgggaattagtttacctaaactttaaagaacacacatttccaattatcaataaaatttaagtagcatagaaaaagattgtatatacatttttgaattgatccttccagaaatcttatgaagtagccgttcttatgtccatttggacagaaaacaattatggtatttagggaaactaagtaatgtatcaaggtcatgtatacagctgcttttttttttccttcttggccacataatgtcattttggagttgtgagccatggggtaacattgtcaggtttgtagcgtagattaatttttctggcagaaatgtgaatggtcaatttgtgagatccaagactggaagcagggtcatgtatcacccttagctcctatctttccatcatagcccatgtcccacacatcaggaaagctgttagctataatttgaacatgtatcaacaagtcaacttacttatgtaaggccactgcctgtatcttcctggcttcagcctgtcaactccttccttcatatacagtagcctcctaatttattcacaaaatgctccaaaatgaatatattaacttactaaccttacgactgtagcaaatactaacagttgagtaggaaatttacttaataggcagcttgaaagaaaattcaagtcaatgcagtacatttctgctgcaaatcatttctgttgcaaaattactccatttgattcttgtttttcagtggtcttgccagaacaaagttgctattctgggtttgttttttctcttttaaaataattttattcaatttatgaatttgtttcagtttttaatagaataccctgacaaacattgtatggaaattccaaactaaaactaaacaaacattgccgtgttttcaactgtttcttttttatactgctctgaagaagaaaacaattctccctgaacaaattcctattacaatgaaggcaaagatcatgttttaaaaatatttactgccactatttgaagaaaacttctaggattgttgttcgggctcatacatttttaaaaaaggaaagtgtaagagaaaaaaaaaaaaaaagcaaaggaaaggctggtcatggtggctcacgcctgcaatcccagcactttgggaggccaagatgggcagatcgctcgaggtcaggagtttgagaccagcctggccaacatggtgaaattccatctctactgaaaatataaaaattagctgggttttgtggtgggcatccataatccccgctacttgggaggctgaggcaggagaattgcttaaactcaggaggcagaggctgcagtgagctgagattgtgccattgcactccagcctgggcgacacagtgagactccatctgaggaaaaaaaagaaaaagaaaaaaggggaaacgaggaaagaaggaaaaagaagagaggaatgaatgaaaatggaaaatagaggacagggaaaaataaatgaaagcttaccttactacgcaagtgccctattttctacacataggaaagctaatgaattgttagtcttgttttttaaacttggaaaacttaagtcactttttttgtactgatattttcctgatttcaaaaaaagttacccaaattaagaagctaagaggaaaatgtatttccagttaactgaaatattaagttgagcaatcatttcatataggatctgcgttcatgtaagtgcatgtaaatgctctcagggtagatgtatgtttgggacctaataaagtttcctcctctggttttagaaacaggttaggatcacaaaatcatgatacaactaacaacttcaacaatcatcctcctttgtttggagcccattgcaaaacctcttcataaaattgaacccatacatatagtatgatgcttgcaaatctgaaaaatccctttttggacaaactaactcatcttgcaaaacttcctacctggagtttcctctcagtaatccttaacaggaccaaacatccctaattgtataaactaaagaaaattaagactagcaagacttcacattgaccccagaattatttctaaagttgccaaatacgtttttgtctttgtgtctgtagcaaatctcttactcttgggacctcattacctgagtcccaggacacctcaaacttctctgaaaagccaaattgccttaccatgggcctgtcgagaattcctgtccctcttcaatatttgtcttacctttgattcctgttttattcaactttaatgaatcctactgtctcttcatggacccactatccacacctgtggagtctgggaacgttcaatgtggtagaaaaatgtaaaatttttatttatataaaaacagaagacttgtaattcagcagctgtgcagtgtttttctagcaactgtgtgctcttttgcatttggtacagtataaacttctagtttgttctgctgtcatggaacatggtcccagtaaaccttcctgaggtcagcaacttggaccttctgctgtctaggtcccatgcttggcgtagtgtggataataatgttaaatattatatggttttggcttcactgagccatatcagaacattcacaaatagctgtcatacaaattcctgcttcttattgccccttttccactgtgcatagatgcaagaaaatagtttcatggccaggtgctctttgtttcagcttcctttgtttctcccaaggctgcatggcaaatgtatgatttgttcattcttttaaaaaaaattgagtgctaagtgccaggcattatgaatgtatgtatgcttggaagagggggagagcagtgttattatctaactcacattttgaaaagatcactctgattgctttgtagaaaatggtaaggggtgttgaggaggggtgctgatgtgtctggacaagtaaaaacattccctagttgtgattagttcaaaaggaagcttaatagtctaagaaataaatgtaaggtattagtttgaaaaaaggtcatgctgattaattgcatgtgcaaggggaggggaaaagagaggggagatttcttgatttatgggtaggtggccttgtgtttagttaggaacactgggagaggaatggctcatgggcagaatcatgagtttggaaatattatgtttgaggctcatttaagatacacaattggagatgtcaaacaggcaactgaatatatttaatatgagccttgatctggataattctttagaggagttaaacattggggtttttatagaatataaattgtatttaacctagtttttgaaagcatctaggatagaatacagattaggaagaggatgggttccaggactgagcccagagattcctcaggtaaagtaaagaaagagaaggtaggactaagagactgaggagtgaaccgtgaggttgctggaaaaccaggagactgtactgtttcagaagccaatagattcatgcattttaagaatgacagagtggccagttacattgaaggctgtttaaagtcgagaaggatgcttggaatgtgtccattagatttggcaacatggaaattgctggtaaccaaaatgccagagaaggtttatcagagtggctgctgctgttgaagccaaagtgggagtgatctgagttgctgatgggagtgtctgttgacctatcttttgagaagtttggctaagggcagcagagaaatagcatggttgatggaggggctacggggtaaaggaagttgctgtgccttaaaaatgacaccttagagctgggtgtgttggcatgcacctgcagcctcagctactccggaggctgaagtgggaggatcgcttgagcccaggagttcaagtccagcctgggtgctgtaaggatacctgactgaaaacacacacacacacacacacacacacacacacacacacacacacacagataccttagagcagcatttattaaaccgcagtttgtgaaccataagtggtcttaaaatatttttattgggttgcaataatcatttaaaacattaattggagtaaaagagaaaatagggtacatgccatgtggtaaaggtaagaattttatttttgtggactatattattatgaagaatttacaaatagttacatatctacacacatatactggtgtatattggattgtaatataaaatgtatttcttcacgtgaattacggttttaaaatttgaaggccatcaaactagggaatgtttgcatgctgatagggataatctagtagagagaaagaaactgatgacacaagagagtgggaaaaccaaaggtgtaaagtccttgagcagagtgaagaacttttcacacaatcttctctcttttctcatttatttaccatgtggcttccaggtagtcatcatcaatctaaccgtaactgaacaaatcccatgtttctgcaggtatgtgcggcagtgctgatgtttttgtcaacagcaatgatttgacatcagcactgggctttggtttaaattgtttcctctctcctttttctaaatgtgtatgttaaagttctaaccaccagtacctcgaagtatgactatatttggagataatgtctttaaagaggtaattatattaaaatgaggacgttaaggtgggccctaatccagtatgatcagagcctgtatgagaagtctggacacaggcaggcacagaagaaagaccatgggaagacgctgggagatgatggacgtctgtgagccaaggagtcttcagaagaaactggctctgcttacaacttgatcttggacttctagcctccaacattgttgagaaaatgaattgcagttgtttaagccactaagtctgtggtgttttcttacggcagccctagcaaatgagtacatactgtcatgcttgttatttgatttggcctttgattgttacaacagcctgaggtgtggaggaccagaattataaatgccagtttacagatgagaacactgagatgaagagataaatgactgaccgaaggtcagggatcaaaatagctagtaagtgatacacaaagtgttgtagatcttttccaagtgttgtttccttggcaaaagccttggtggcaggccctgtagtcatggcctgcctgtagtggtagatatgactctatgctggtccattaattagtgccaaaagctacatttctctgcaaatatagattctagtgtgttctgaaataagacttacaacacttaaaaacttaaggatgcctagtgatgaaatatattaacattttttaaccatcacttttatgtagcccatgaaattatacagctcaataaacatttgaaagtttagtctctcaatgagaagtgataaaatttgacccgtgcatgaaaagaagacagctgattctttaaagcctttttgaagagctatgacatttctgtaaacatgcaccaaggaatatctgaataaagcaataatcgatcaactaacattgtgttggtttcctgatacaaacacctgaagtgaatgataccagtaaagttaccatccttttttctgcaatgctttttaggtcattttaattttaagctacatgctcttaacttgaattttaaacttcttaatggaatgtacttacaatgaataaatgctctgagtgacacttagagtttgcaacacgtttagcatgttgtgctgattcactaacgtacgctttctttcagattacttttactaagtaaaagtagtctacccttacactggtgaataagacaatatttcaaaaaattcctaaggtaacatagaggaaatgtgtattttgtgtgtgtgtgtgtgtgtgtgtgtgaatcacctttcagtataatgagaaattttatttcaccttatgaaaacacatgagtttttttagcatacaaacttaaagatcaaatttttaggttgtacgttgtgtctgtcttcagctgtgtaatgctaaatagatcttcaggttaccatcttatctattatgcatttgattctgttttcccacattctaaaatcagtcagattattgatttttacaatctaaagaggataatatgttagctgattattttcataatttgtgatttcctgattattagtgagattattagtgagacaaagagatctttgacatatttattggccatttgagtgtcttatgtcaactgtctattcatataactagcctgtttttctatttatttttattttcttacaattgaatttatccgttccttttgcatgttgtatgatactccattttacctgtgagatttgtaactatcttcttccaacctgtggctttctttttactttgcttataatgtattttatcttataaaaggtttcagtattaatatgttcaaatatgtttatttttcttttatgcttttttcttttctgtttctatctttatatcatcaatatagtctctacgtaataatttgaaagttaaatatttgtttacctgatttaagttattaatcccatcagaagttactttttttgtttttgtttgtagataaggagttatctgattttttttctttctctgtatggttagccggttatttctgcaccatgtattggatagtctatcttttgctcagacatttgtcataggctgtatcctaagctctcattggtacctgagtttattttaaggtcatttattctgtcacttttgttcctgtgtctattccttaaactatatacactgtttaatttctgaagctttttagtaaaggcttatatcaattaagctaagttctctattcattcacagcaaaatttccttgacagatactgatctgtaacttttccatgtatattttagcaaaaaattgccatcttccttgaaaacactaataggatttggttagaattgctttgattttatatatttatttgtaagaattgccttaaggacatttgggcatatgagcatgatatatagctcgtttgcttatgtctttttatggcattcaatagaattattattttaatctaaaagtcttacctacatgtttactattaatagatttagttataactgtcattgtgctattataaaagtaactctttaaaatcaaattttcttttttcttttcttttttttttttttttgagacagagtcttgcactgtcgcccaggttggagtgcagtggtgtgatcttggctcactgcaacctccacctcccaggttcaggtgattctcctgcctcagcctcccaagtagctgggactacaggcgcacgccaccatgcccagctaatttttatatttttagtagagacggggtttcacaatgttggccagatggtttcgatctcttgactttgtgatctgcatgcctcggcctcccaaagtgctgggattacaggcgtgagccatcagtgcccggcctaaaatcaaattttctaacagtttgctgcagatgtgaaggaatattacatggatatatttagtatatagaaatcttgctgaataattttatccattataatcatttatttattgattttcttagattatgtgggtaaatgtggataaattatataattcttaattcttttaatccttctacattttatttttgtgctattttactgtagtagatattttcaatacaatgaagactagaagttttaaaaccaggatagcaacctcatgggcctatttatgaaacaatacctatttatatgctacaactttttcacctgttatcgtgaatgacaattgacatctaacaatgggaaccataaacactgttgagctctaaatgctttcccagtgcattaaaaaaattaaattgactttctttttcattctttttctctacctctctcagaaacaacttctattatttactcattattatcttattccctaatttttttattttattcaacagatacttactgattgctcaccaatttgccaggcacagctggttttggggggcattccatgatgaataaaagtagcaagatcccatttctcatgaggcttctggattaacaagggagacatgcattatatagaaaattacataatggttatttccttacaatccgatggttactctgaagcacaagtgtagcatgctgtcagagtgcttagaagatcgggagggaatagtgctaatacatagtttggaaggtcagggaaagacatctgaacttgaccacactattgagtatgagttcgacaggcaaagatgggaccttgagcatgtagaatactccagtgacaagagtagatgtaaacaaaatagctctaaaaatagtgttcagtgaaaagtgatttgctataaatattacataggtgtgctaaatagaaaaatagaaaaatgattgaggacagcaaatatctgttgaatgtccctatttggaaggtatttaatatatcactctgaattgttctctggttaattaggaaaagtaagtttaaccaaggggagggcaatggatgttggtacagagctattcaagatcatggctacctgtgtacttgcctcatgcaagacctgtcacccattggaacttccatcattttttctctggatccatttctggtagtctctttattttgatctctatttttccttggtacccatgaggaacacaatttgaataaaagaaaaaaatgtattcataatttagaaaatgattttattggacccactaacatcaccaggaagaatgcaatgcaatattggcggtgggcattttggttaagactgggttggtcattttaatacaccctttcagccagtattcagagcaaggcatgtgcttgcctagacttcacattttagaaaagccagggcctatatatggagagttcttttttgtcagtctcatgaaatgaagtgctgcagtttgcatttttcctattcagtttcaagtatgaacttgattttaaaatttaactacagtttcgttaagatgtactacaactcccagctaattatgtagatgtatcaaatatgtattttatttaaaagccgtattactattttgcttttatccatcaatgattcttggataaaaggtggtaataaaatgttaatgtgtatttagtcatatgcaaaaaagtactatagaaatttctgaggtgtacaatgacatgcattattgcttccataagcgtaagaaaactcagaatgacaagtctacacaagctaggtttcttgttcatccaggggtggcttgctttgtaaccttttcctgaatagtagactaggtactgtcttccttttatttcccctataaattagttgcagtgttcttggggtccttagggacttcaggtggttgagcctttcaccaagcatacatacctagtctgtgaacagaagtctaggactctggaaagcactgagggcagagatgcttccagtcctgtccttacacgacttcccctgccaacctcctctcttccctcaggtatttttcttagtgcgttaaagatatttccttttacactaaaggaagtccagtgaaggttgcacagtgtgcagtggtgcacaaaaacaaaaacacaaaaaagggatgcatgcactctcaatagaattttacatggaaattgggagaagaggactccatctttctaggggacaataatggacactggccaaaagcagctgagtgagagctgagaccaaatccctgggatcagacctttcagccccagccatgcctcctttgggcatttgccttgtggaagactgacagctcctcagtcagtatagagggccagagacacagcgcagtatagaagcacatgtattatgacctggtcatgccaccaatatgtgagctgtgcttttctttgacatttttcattactcagtgaaagaagtagaagccatgcttgtcttttctctgccctggagaagtggagataacaagggctcagcctcatgagatctgagatgtagggcagactgtgtccacaatgcagaacttcagtgaataattaaaaatgagggcactttctaatggtctaattgagcacacggtgaaggaatttccaataagttatgtttaaccatcaagtgacattataagaagaaagaatttcatctttattttataggtgagaaagctgagccttggagtgggtaagccattggccaaggtcataaacaagtgtgtccaattccaaacctaagctcataatgagtacactgtgctgttgtaaaaggggccgtctctccctctttcagtcttaatgggagaaatatttaaaggcatctttgtgagaaagttttctgcaaaatataatgtggtttgaaaaatatgagttactgtgttaggttcagattgttaagactttcttttaatgtagaaggtgtagtgtctataaccattaatttgtgttgcaccctcccttttgtgaagcttattaataaaacagtctgctactccatcctccaattcctgtacttccagtgttcaagtctgctgatcatctactgcctaaaaagttttcccataaacaggaaaggttccagaagtgactttatcaacaaaaacgctgcttcttgctgctacaatttcctgaattacaaggcacagatggacattaattggagcgggtgttttgagagccagcactacctgcctcacactgctgagggatatagaggtctctattcctttctaagcacaggactcaggaagtattctggaagcagctcagaaactcagggtcctgcagggatgtgcctcttttggaagggcaagaaacctcactgatgaacagaagcccctcaacttcagattgcaacctcttcttgtgacacatgagacgcttcttaagatttcaaaacaaaacttggtttccagagggcagctagtgagctcatcctgtttggagacccaggctgtgtcttatctgtgtcaaataggtaatattttgacagaagtgtttccaactagcccacctcatacatagaatattgtactgcattggtctgttgtcatgctgctaatatagacatacctgagactgggttatttataaaggaaagagttttaatggactcacagttccacatagctggggaggcctcacaatcatggtggaatgaaaggagaagcaagccacgtcttaaatgataacaggcaagagagcttgtttaggggaacttccatttatagaagcatcacatctcatgagacttattcactattacaagaacagtatgaggacacccacgcagcgattaagttatctccatctggccccacccttgacaaatgggattattacaattcaaggtgatatttgggtggggacacagagccaaccatatcattccacccccggcccctctcaaatctcatgtcctcacatttgaaaacacaatcatgcccttccaacagtctcccaaagtcttaacttattccagccttaatccaaaagtccaacagtccaaagtctcatttgagacaaggtaagtcccttccacctatgagcctgtaaaatcaaaagcaagttagttacttcctagaaacaatggtggtgcaggcattgagtaaatgcccccattccaaatgggagaaattggccaaaacatagagactacagtccccatgcaagtctgaaatccagcggggtagtcaaattttagagctccaaaatgatctcctttgactccatgtctcacatccaagtcatgctgacggaagagatgggttgccgtggtcttgggcgtctccacccctgtggctttgcagcatttatccacctttccagctgctttcagaggctggtgttgagtgtctgtgtcttttccagatgcacagtgcaagctgtcggtggatctatccttctgggttctggaggatggtggccctattctcatggctccactaggcaatgccccagtggggactctgtgtgggggctccaactccacatttcacttcccacactgccctagcagaggttctccgtgagggcctcgcccctgcagcaaacttctgcctggatatccaggtatttccatacatcttctgaaatctaggtggaggttcccaaacctcagttctttacttctgtgtacccacatgctcaacatcacgtggaagctgccatggcttgggatttgcaccctctgaagccatggcctgagttgtaccttggccccttttagccatggctggagtggctgggatgcaggacaccaagtccctaggctacaaagagcagggggaccctggtcccagcccatgaaaccattttttctgcctagggctctaggcctatgaagggaggagctgctgtgaagacctctgacatgccatggagacattttacccattgtcttgacaattaacatttggctcctcattatttatgcagatttctcagctggcttgaatttctcctcagaaaatgggtttttcttttctatcacattgtcaggcagcaaattttccaaatttttatgctctacttcccttttaaacataagttccaactccaaaccatatctttgtgaatacataaaactgaatgcatttgacagcactgaagtcacctcttgaatgctttcctgcttagaaatttcttccaccagataccctaaattatatctttcaagttcaaagttccagagatctctagggcaggggcaaaatgtgaccagtctgtttgttaaagcataaaaagagtcacctttgctccaattaccaaaaagtttcttatcttcatctgagaccacctcaacttaagcttcattgtccataccactgtcagcattttggtcaaaactattcaacaaatctctaggaagttttaaaccttcccacatttttctgtcttcttctgagccaactaaactgttccaaactctgcctgttacccagttccaatgtcacttccacatttttgggtatctttatagctgcaccccactctaccagtaccaatttaatgtattagtttgttctcatgctactaataaagacttaaccaagactgggtaatttataaaggaaattggtttaatggactcacagttcctcatggcttgggaggcctcacaagcatggcagaaggcaaggaggagcaatcacatcttacatggcaacaggcaagagagcttgtgcaggggaactctcatttataaaaccatcagattttgtgagatttattgactatcaggagaacagtatgggggaaaccactcccatgattcaattatctccacctcgccttgcccttgacacatggggattattacaattcaaagtgagatttgggtgaagacactgagccaaaccatatcataaacttatatggcatatgatgggaaacttttatttttccatcacaagtagagtggtaatatatacaaagagaaaatgggtatcaggtattggcaatttttattttcattgttcatttacatatgaatttttagtataaatttggagactttaagtattcatgtcagaaaaaaatatttcagtgaataagtttcagaaattcaacgtcgtatgttttttttcttttgcaaggtcagactgtagattcctttaaaaaaggactttttattgatagaaaatgtgtttatagaattttaaaatagtatattctgttcattatctctaattttctcactctgctatactacatgcaattatatgtctaatgttatttatgtttatttatataaatttgctgttaaaatatattcaattccctattcctctaaaaagaacaaaaataatgacaatttattcgtattttttttcttggctatgaactcaaatagatgaaatgttatataaattaacaaactttaatagcacgtattggtgatgtgcaagtcaatagttctcaggcatttaccttcctagcactttcctatttgctgagagtagaagcgtttgggagaaatatacaggatagtacatgcttttcaggaactcacacctagctggaagggcatacctaccacagtggaaacagtcagagaaaaatccatcttggaatgtgggaaaatgattgtagctcttgaggaatttagaaagggagagatctttaggggctgggaaatgacaagttactaatatgtagactgggcagttcctctgtgctacttccataagcaagtgctttatactcacactgttgcatgtaaactcctcaacatttctgtgatagaggtactgtgagatgttcctttcacagaagaaactgaggccaaaaaagtaatgtgacttacccaaggtcccacctgtcataagtggcaggctcaggcctcatttacatggaattggtgtttttaaccatctctgttctctttgcagtggttgtaagtgcctcggcaataaaatagctaaacaccatcacagagtgtatagagttctcatgggctaggcattgtttcaagtgtcttttcttgtgttatctcacttcatcctcatataagccctatggatcacagagaattatgtgccttgcctaaatctgtcatgcaagcaagaaagatttgtgttggaattgaagaacgggcatgatgttgatgaacatttgggatgaggcacaagtgtttgaatgggctgatctctctgaaactggcagaggcagggtgaaggtgctggcttcaggcaggaaggaggccagactgtagggcagattctcatttttgaactaaaggcatgcagtaggaaacctgagatttattcagaggagcctagaaataacaggctagaaagaggaagggaggaatggagagcccttagacaattgaaagactaaattggccagcaaggaacagagatttcccattctacaatgggaaagaaagatgtggtctaaggtctgtgttaatgaagaaatgctggattctgcagtaagctttctgggagtctccactccataagcgggaaatgtaggaatttgtatgctttaatcaagtatatttctcaagaccacatcagaagtttttcttttgtagagtctgcattgaaatcatcatatagtttaagaaactcacttcgaggtagggacaacaatgttgtagttagcattgacttaaaatgtgagaagcgcaaatgtaaaaattcttacttgggttctctaaaaaagaaagtatgataattgattaatgtatgagcagatgaaccttcaccagattttgaaagcaaacctttggaacatgtaatgtatttgaagatacttttctagattttcccacaaaggatcttagtgaactgatcattcatacttcaaaatagaatttgagaataatactgtttgcaatcaaagttgggaacaaatctcatcaatatgattgggctttgtgtccccacccaaatctcatcctgaattgtaatccccataatccctataatcccaacgtgtgaagggagagatcaagtggaggtggttgaatcatgggggtggtttcccccatgctgttcttgtgacatatggtgaattctcatgagatctgatggttttataaggggctctttcctttttgctcggcacttctcctttctgccaccttggaagaaggtgacttaattgacatgtgagtcaattaaacctctttcctttataaattaccgcatctcgggcagttctttatagcagtatgaaaatgggctaatacatctgtcttcactatttactagttataaggctagtaaatagccatatgactgtatggcataatttaatttctctaaaccttagttttcttatctgtgaaatgggttaataatacctacatcatagaagttatagtgtattaaaaatagcacatgtaaaatgatgaacatgaagccaggcacatgtaagcaatctattaacattatcatcattttcattgatgttccctatagagacagtcatctgtggatttgatgcaggcaaactagatacctttaataaaaatatgaggtagttagcaactgcaaaggaaccttcttattcagagctattgttactgtcagcagtgttaatatattaattttgcttggtcattgactcagtgtataaaatatgtgggcagtgaactgaggaagcttagggaccagtgtgaaaaagacatataaatcatattaatgcagtagaagtgttataatcaagtgtatttttaatggaagcccatagaatgtgcttttactgtatggttagctgagtggttagccgattggagaagtgggcaggaaagtgacatttgagtctagatggatgagtaagagtctacttgaaagatgagagtccaaggaggttgcaaacagaaccctctctgccaccagaagcatgaaggtacaaagaaaatggcaggcagtaagcatgcgagatgttaactatggaaagagtgtggagtacaagacgagagaggcatgagctaaggctcaatgaggaagggcatcatttgttatatttcacatttatttgccataaaataggcttaggacaggtgtcttgatcgttaagtgcaaaagtcacatgatcaaatttatgtttcagcaagatgatcagagatgatgcaaatgaaaaattacagggagagaaactgaaaaaatattgttatgttttaagtgaaaagtaatgaggtctgcgactaggcaaagacatggaagataaatggttgggaattcaggtggaagacttttgggaactgcaagccattgaattgtttactgaatgtgggaatttaatagcaagtgaattatatgtccacatttgaccaataaaacaatagtgacatccttagaatcaagcaggaaatgcaaaatgaaaagcaggatttctttgagcatgtaagggaatttaattctcaataatttattgatttatttttattttttatactttaagttctagggtacatgtgcacaacgtgcacgtttgttacatgtgtatacatgtgccatgttggtgtgctgcatccattaactcgtaatttacattaggtatatctcctaatgctatccctctcccctctccccaccccacaacaggccccggtgtgtgatgttccccttcctgtgtccaagtgttctcattgttcaattcccacctgtgagtgagaacacgtggtgttcggttttttgtccttgggatagtttgctgagaatgacggtttccagcttcatccatgtccctacaaaggacatgaactcatcctttttaatggtggcatagtattccatggtgtatatgtgccacattttcttaatccatccagtctatcattgttggacatttgggttggttccaagtcgttgctattttgagtagtgccgcaataaacatacgtgtgcatgtgtctttatagcagcatgatttatagtcctttgggtatatacccagtaatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatcttttcatgtgtctgttggctgcataaatgtcttcttttgagaagtgtctgttcatatccttcgcccacttgttgatggggttgtttgtttttttcttgtaaatttgtttgagttctttgtagattctggatattagccctttgtcagatgagtagattgcaaaaattttctcccattctgtaggttgcctgttcactctgatggcagtttcttttgctgtgcagaagctctttagtttaattagatcccatttgtcaattgtggctttttttgccatagcttttggtgttttagacgtgaatttcttgcccatgcttatgtcttgaattgcctaggctttcttctagggtttttatggttttaggtctaatgttgaagtctttaatccatcttgaattaatttttgtgtaaggtgtaaggaagggatccagtttccgctttctacctatggctagccagatttcccagcaccatttattaaatagggaatcctttccccattgcttgtttttgtcaggtttgtcaaagatcagatggttgcagatgtgtggtattgtttctgagggctctattctgttccattggtctacatctctcttttggtaccagtaccatgctgttttggttactatagccttgtagtatagtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcatcgaatctataaattaccttgggcagcatggccattttcatgatattgattcttcctatccatgagcatggaatgttcttccatttgtttgtatcctcttttatttcgttgagcagtggtttgtagttctccttgaagaggtccttcacatcccttgtaagttggatccctaggtattgtattctctttgaagcaattgtgaatgggagttcactcatgatttggctctctatttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaatcgaatacactttttttctttctcctgtcttattgccctggccagaacttccaacactatattgaataggagtggtgagagaaggcatccctgtcttgtgccagttttcaaagggaatgcttccagtttttgcccattgaggatgatattggctgtgggtttgtcataaatagctcttattattttgagatatgtcccatcaatacctaatttattgagagtttttagcatgaagggctgttgaattttgtcagaggccttttctgcatctattgagataatcatgtggtttttgtctttggttctgtttatatactggattacgtttattaatttgtgtatgttgaaccagccttgcatcccagggatgaagcccacttgatcatggtggataagctttttgatgtgctgctggattcagtttgccagtattttattgaggatttttgcatcaatgttcatctgggattatgatctaaaattctgttttgtttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggaatttttttggttggtaagctattaattattgcctcaatttcagggcctgttattggtttattaagagattcagcttcttcctggtttagtcttgggagggtgtatgtgtcgaggaatttatccatttcttctagattttctagtttatttgcgtagaggtgtttatagtattctctgatggtagtttgtatttctgtgggatcggtggtgatatctcctttatcattttttattgtgtctatttgattcttctctctttttttctttattagtcttgctagcggtctatcaattttgttgatcttttcaaaaaaccagctccttgattcattgattttttgaagggttttttgtgtctccatttcctttagttctgctctgatcttagtaatttcttgccatctgctagcttttgaatgtgtttgctcttgcttctctagttcttttaattgtgatgttagggtgtcagttttagatctttcctgttttctcttgtgggcatttactgctataaatttctaaaggctttcaaagtaaaaaatttgaattatagcacaaatgtgtcattttagaaaatgccaggtttataggaaaaagttataaattgtaaattgtgattttatcttactgtgtcaatcagaacagagccaaagatgtggcttgcaatttactttaagaaaagaaatcacatatttgtagaatattttgtaattttcacttctcctttccataaactgccttgtttaattccttgaagagtctcactattctttcctttatgagggttctacaaatgtcccttaagcaaacactaggtataaggaactgtcctaggttccggaaacacctcactctcacagaggatacattctagggatagaataggggagttataagtatctagaatagaaagtcttaacttgggccctgagtagtatttggggatagtgaggtatacacgatctcaataaaatttacgtaaaatagttctaagaagagacttttaccagatttcaaagactttcataatcctaaactggttaagaatcatggttttcaaagctgagcctcaaagaagttagctgacttgctcaagttcccaagaatcaagttacaatttggatcttaatgtactgtgcagtgccattcaacccctcattgctaattgtcttgccatctttatctccaaagaatggtcaattttcctgagttctaatacattcctcagtttacttattataaatgtcacttccaatccggttgcagcaattaataattttgtaatatagctggatcgactttaatttcttttggctttaagtgcagagacatccaatcctgctagttccaaaggtgttttctgaaggcagtgttcccaaatcactgttggaaaggaatatggcaaggctcctgaagaaattccggtggaatttctttaatcatctggtggaagtggagatgtgtgtggttcctaagaatattgtgagtcctatatttaggacacagaccaatgcctttgaaatggccttcttggcttcctgcagtgtggagctgtgatctccatggtgagatatcccttatatttacacactgccacctgacctttgggtcagggcatttccaatcgatttaggagtgcagcaagtgcaacgacggtgttgatgagctcttacagcatggtaagcaaggctgcctgggactgaggggcgtgggaactctattgatttttaggtactttttatcacatactcctacactgctggactttgaattaagttagttttcagacaacataccagagggcaagaaaacaaaaagtgggatttttacacataccctggaaacaagttaatttttcctggggaaatcaagtagagagctggttaccatcttagcaattaacagaagttagacaaaatgtttaacaggaattggctttgtggattatggcattgggttaccagaacagcaatcaaaatgcacctcagtagtctcagtttgttagaactgtgtctcacttcaaatataactttgctctggaagaatagagagtctcaaattcacttgtgggatcctcaagaattttgcttctctgattgccaagcattgaagcaataatttgttattgaattgaagcaagacaacaggaagataattttatatcagcctgatggcgttgtttactgaaactctaataagcttttgggcatgtagtatgtgtgtgtgtgtgtgtgtgtgtgtgtgtgtgtgtgtgtgtgtgtgtgtcttgatttagggttaagtcttcctgatttgaaggaataattttaaataatattgtcagcatggccctgtgattcaacatctgttgctgtgttttttcctaaattccagtcttttgtatacacttagaaatttggatgatttacattggatgcttttttttttctgctcacttttaatctttacagtattttctgaaaggcagcatcaaattctgaatgggcatcactgattcatttacacatctgttaaaattttattgagcacatactatgtgtggtgtaatgcactactttccaatgataaggaatttagataagcaaaatgtgcttcaggtcgtcaggccacggtgattataatttggagagactgtaggtaggcaactcattacaaatgaagcagaatgaaactatcactaaattgagtaggcaggaatagcttactctggcagaaggcacctgagaatcctaattgagggaagacttttaggttttaagtaagcaaatccaccactgggagaatgacaaaccctgtcagtcacatgcctttattatcatggctctgctttcagtacctcccggttgtgatatctgtactcttctctctgctcatccaaaaagtctgcattatttcatgttaagagaatagtttgatatttactattggccaaagcaagaaaggctttgcctactccatgctatagcttagtatttgtggtgtttcttcattattggtgtacttctctacaggatttctttatgatggtttctgtctttagatactgacctaaattattacttgccctggccttttggggaagaaagtcataaaatcaactatgccttagatctgcattgtcaaatcggaagctatcaaccactgtggtcaatgagcacttgaaatttactagtcccatttgcaacatgctgtaagtggaaaaaacacactgagtttcaaagacctggtatggaaaaaaatgtaaaattttatttttatttttatagtgaatacaggttgaaatgctgagaactttatacatatatctatttaactatacatatatttaactaatcaattttgatttattatatataaaaattatatatatatttatggggtacatgtgatattttgaaagatacaatgtgtaatgatcaaattagggtaattaggatattcatcacctcagatatttattctttctttgggttgggaacattccttatgttctcttccagctatttcaaaatataggttaaatttattcataagttttttttttgttatcccttataaatgtgattgctctcttgatttcttttagagattctctgctgttggtgtattgacctgatactgatttttgcatgttgattttgcatcctgccattttactgaattcatttatcagttctgctagtttttttggtggagtctttaagtttgtctaaatataatatcatgtgtgaacaaggataatttcatttcttttttcacaatttgggtgtcctttatttctttcccttgcccaattgtgctggctggaacttctggtgctatgttgaataaaagtggtgatggcaggtatccttgtcttgttccagatcttataggaaaggcttgcaatttttccctattcagtaagatgttaactatgggatttttataagtggtctttattattttgagatatgtttcttctgtacacaatttgttgagagttttcatcataaatggatgttgaatgtaatggaatgctttttcagcagctatgatcatatggcttttgttcttgattctgttaatgtcatgtatcatgtttattaatttacttaggttgaaccatccttgtatccctaggataaatcccatttgattatggcaagtcaatttttttaacgtgttattgaacttgcatgatggaattttgttgaggatttttgcatccatgtccatcaggagtattggcttgtagtttccttcttttgttgtgtctgtgtctggttttggtatcagggtaatgatgggcccatagaatgagtttgaaagttccccttctcttcaactttttggaatagtttaagtagaattgttattgcttcttctttaaatgttttgtggaattcagcagtgaatctatcaggtcttgggcttttctttgatgtgagacttttaattgtagcttcactctcattacttattattggcttgttgaggttttctatttcttcattgttcaatcttggtaggttgtatgtgtgcaggaatttatccacatttttttaggtttttcaatttgttggcttatggttgttcagaatatcctctagtgagtctctgaatttctgtggtatcagttttagtatctccccttttcctctggtttcattgaattgagtcttgttttcttaattcgtgtagctaagggtttgttgattttgttcatctttgcaaaataacaagttgtatttgttgatcttttgttatttttgtatccttaatttcattttttctgctctgatctttattatttcttttcttctactaattttggaaaacctttatacagtgggttaaagaaaatatcttattaataattaatattaatttcacctgtttctttttcctttatttcacatggctaccagaaaatttaaaagtttacatgtggttttcattatatttctgttaaacagtgctgcctaagatagtgcttatggaactgttgtcacaaaacttatgtataagtgggttaaccgagataataaagctgaattcaaggtgtgtagaatgagcactagactgagatccagggactgattcagtcccagctaggacttggtctcctcaggtagccattcactctacgtgtctggaatggagtgcactcactgaaaaaatgcggaaaagattgagaagtagatcatttctaacccccttcctacattaaattcagtgattcaactgtgttcaggagtatacgattgaatcatacttgtagccctcccagtatcttctcaaagccttttagacaaaaccgtcttcctcattccacatcataatttatttgagaggttaaatttgtaattactgtaatttggagcttccttgatcagcctgaggctggagcacagcatccttcaatctgttcagtgctaagtgaatcagttgaacatgttgtgatttataaggatctgataaatatgttttgcaagaaagtttccagcactctttgaaaaaatttagagtgttctgaaagtaaactgtagtttttatgtcatttcaaataattaagaagaaattgtttcttattttttaaattaatattgaaaaatctatttctaacttaaattcacaggtaaaaaatgtggaatacttcatatatttcttataatattaaatatcttattaatattttatatcttacactttgatataaagaaatataagaaatatatataagaaatactctagccatatctgacttttttccatgtacgtatatttgaatataatatagattgtagtgtatatgttttagttttttaaaaaagttttaacatgtgttctactttggaacatgagtaatttataatattttttcttataaataatagtatgtttacatgtgcatatgcctgagataattagtttaggatcatttcttaatagagaaatgctggtcaaaggacataaatattttaagattttttcatatttataataaactttccttccaggaagtttgtattttccatttgtgtttcccttagcagggactgcctgttccctgcaaccttaccaatactaaaattaagattttaagttttgttttggttgacgagtgagaaaacatactttatttttgttggaatttatatttcttaggttactaagagaatccaaaattatttaatgagcatattggcaacttctaattcttctttgtaaatagcttgttttgggtttatatcgtctatttacttacttattttggatagttttttgttttgttttgttttgatagctgagctggtgagattatatagcacccttgaaaactttcctctttgctctgacttccaatcctgttcagtcatagacagccctgcccctgctccatccacatgtcacctgagcaaacaagcatatacaacagggggaaatcactgtagtcctcatcttggcatgtgggttccagaaaataatcaagcccttataagaggaagaagataatttaactcccatttggtccttatattggagtcttttagagcaattttttctagtttttcctttccaaagcaaatgaaaagaccccataacaatactagctttaagatctctgctgtaaacaaggattctgagtcaattgggataccacaggttagttacgtgtacactggtgtatccccttgcaaaatcacctgccttgagctgtcattacagaaccattataagaaagggccatataaaatataaaatattttaataaattggttgtgaaaatattgttatggacactgttttgtataacactgacattccaatacacaaaggatgcattataaaagatggagtgctagaaaaagctaaagtgctcttcaggtttatcttgcttctgatacgtgttactgatgatgtttcgggaattgcttgtctgcttggaaactcagagccaaatttgattcttaatcacagcaataatattggctgttagtattgactattttggtaatgtatttttatgctccaatttatatattacctataatttctgatttcattatttggtaaatttttttgtgtggatttttgtgtgggtgtgtttgaattttgtctgtctgtttgtctgtttgtttgtttgtttgtctgaaggtttttggaaaccttcttatttctgaaaaagagcaaggcctgtgattaagaagagtttttgcaagttcagtgaatactgtcatcattttcataataactttaaggtttattacagaaaactagaatagatttttgcctcttcctaggcaaaaaaagctgttgttcccaagcagaaaggtgaaagtcatcttgtattatttcttggcttttcatttttatatatgtttgcttgccttaatgataataatgctctaatctaattatcaatcacctgtttaatgctattatttctgttaattcatgggggcagctaatgattttaaataaggtagttttcacaagaataagtgaacaacatgaaactttttgtcaaatcaattttctaggcatcctttattttctgggcatcctttgggtttattcagtagaatagtctttggaaaatttgtaaatcatgcaataattgaaataaccaaaatactgtctccttatacacattttacataggaatatgctttagaaaactaagcaaagtataagtaaagggaatattacagaaaggtaaatgtcagtgttcttctattcaaattatgggctttaatttccccagccttttggtggtaagtgaagccatccttgtcttgaaaactgtagggggaactgtttacatggcctactttagacccttatgttattctgagtttttttcttctccagggaaataatttttaactatgtttgaaagaatgaatttaaggcttattaactgaactcgtcttcaaaaatttagaaacgatggttctgtcaaatcagataattttcttcctgtgcattaaagcataatatgaggaaactattagctacaaagcacatttaaatgctgcttggatattggtgtgcccttgctcattttcttgagtgtttctcaattcaaaactcaaaattaactgcatacttggcatcaggtcttgccatcaggttgaacctgagctgatgtcaatgacacactgctttggagcccatgggtaggtgaggggattgcagtctctcttcagtgtgggattctgaaaagaggcaaactgatagaggctccaaccaaataactgtacccacacattgagggactgaaggtaaactcccagagaagagacaaagacaggaggtggagagcagaatagtcaggaaacaagttagtcacagactttactcagatccgggttgtgcaagcaatgcagacttgactcttttgtcccatccactactcactgcccactgcactctttttggctgggttgtattattaactgctgggaatatttttctcaacttccattagagtggggattctcatatgagtagtagtaagtagaatagtaggaagtaagtaagaagagtagtaagtgaaattctgaagtactacctcttcctgcttttttctactggccttaaacatggatgcaatgtctggaactgcaatgattatcttgtaaacatgaacaagagatgacaccatgcctaggaaacactgaatttctgcctgcttccagacttctggtcataggaggaaaaaacaaaacaaaacaaaacaaaaacccccattagaagtcaaaatttctgctacttgagttcaaatgcattcctaacttatatactttgttgcctcgtttgttgccttctgctcttcaatagtctcactctcattggggaagaaaaatatataaacttaaagttcttattgcgacacttcttaatacctaaaattgccatcctgttgagccaggatgatcctcacatatgaggtacttagtagttgcttgttgaatggatgtgaaaaatattcctgtttttcactttggccaaattgaatgatagaaacgctttgggcttctctgacctggcagttccacagtgcaaagcaacattctgccctcagatcagcacacatctttacttatacaaaccctcactctggggtgcttattgttatagaaatctgcttctgtttttggcttccctgatggaaggaaaaggatgcctcagttcctggatgtattgtatgaaccttggctatacttacataaagcacaaaataactaagaaatatgctcaccccgtaaggatttatgtggagctcactcacaaatactttcataactgctgagaatcagcacggtttggtgcgatgttgaaaagtcatcagaatcaaaaaactatgtgtccaggtgcggtggctcacacctgtaatcctagcactttgggaggctgaggcagatggatcacctgaggtcaggagtttgagaccagactggccaacatggtaaaaccccgtttttactaaaaatagaaaaattagccaggcatggtcgtgggcgcttgtaatcccagctgctcgggaggctgaggcaggagaattgctttaacctgggaggtggaggttgcagtgatcagagatcgcatcactgcattccagcctgggcaacagagagagactgcatctcaaaataaaaaaaagaatcaaataaactctgatacccatcgttaccaccattggctgtgtgctgtggagaaatttagttaacttttctctgaagaagtattccttcctttgtaaaaatagacataaatatgccagtttcccaaagtgaatgggattaaattaaatcatgtatacatatataaagtgtttggcatgtagtaagggattaataagtgatacctgttatattaatggttgtggttatcttgcaatatgatagttgaaagatgtgctgattcaaagctgtcaacccaacatcttcctgggatctcacctgccttgctgtattatctgctggcgtctccaagggtgaccagcttgaacgatttcattatgtgtcactactacaacattttacacaaatacaattaaacaagttcgtcttccagcacactagttgggagttaaaaacagtttctattgatttatatttttgatggacttcattgagaatgttctgatttgtgggttaatgctttcttacattgagggttcccaggagccctgcagtgaagatggtaacctttacctaaactcaccagaatgattaattaatgtttacctctaatgagctaattaggagtttgggacattttggcattttgaatggcttacttgattatctaaagggaacttttaccatctcaagaggaattataattggccttagggaataatagaatcacctaaagtataagaaagcctccctcatgttggcaaacaacctgtctaacaaatgtcccctttgacaaaacagcccgcagtcacaaatacgagttgaaatcgtaaggggaactctgacaggatttacagttacattaattgctcgctcttggcatgggtgatttttgtgattagaagaggatcagagcagctttctactcaagtctttggcttgaggctgatcattctccataaacaatgacacctttgggagggcagccaaaaatgtcccatagagaaatatcaggagagattcttacttaatgagatatgaataaggctgttgagctccaccagatctttgcttgtctccttaatgaggaaacatcacagtgggtgaagtggtgataatgttaataaccatgatccaattcaatgaatggtggaagtaaggagagaattcaggaaacagacgtaacacaactctctatacaaacctctgggtcagttatgtaacttgattttatgtttatcttcaagtgagggagttagtgcgcctggcttatgcagtagttacacataagacatgtagatggaagtctaataagtgaaggagactaaatagaaagtcagatgtacctcagggagaaaacgtgattcataccaaaactcactctacggagtgagagagctactcagcactttaatggaggatatgatcaagacttgattttccatttcgttttcctttttggaattatgcacttcccaacagaaatgtctaatttggaaaaaaaaaaaagggacctccactgtcaagttgggggaatgagggcaggaaggagaaaatgaatataaaagaaataaatgaaggacaagtttgcaaaaaataggttgtgcaagaaccaagaaggtttaaaacaacgttcagagtaatgagctcaattcactaggaatggggagttcttgaaggaattgaagcaaggagattacctgattagagataggttgcattttaggtaaaggtagaaataattattggaatttagaaaacctcccaaaatacctgattataaaatcaaagttattatctagatattcaagtattaaataacttttaaataacctgaaacacatggatcttcacatatgtgaagaaagcattttcccagccacattcattatccgtaaaacattttacagtacctgtcatagaagacccgtcccatttatatataaagtttcatcggtgctctttaatgtcacattattttaggtatggttgtttcaactgagtgcacacatctattagtgctaagtcacattggataatgaagcactgttattcccacgaacctgtgttaggtggaccagggattttaattaaatatctgaatgagtgttgtaaagtggatactctctagaaagcatctgtcagggttaatactttacaagttagctatgcctctttcaacctttaattataatattctaactctttatccttagttactgctaataatttcaaggttatacagatagaaattacttgattatccaagtgcctgcacttatcgaatgaaatagaaatcaatttcactgtacatggtttataagtaagcaatgctaacatattattgtatttttctaaaaaaattctttttttaacaaaaggaattgaaaaccacatgatatcctgtggttgaaagtgcctaatgcctgccacatatgtaacaaaagtaaattcttaataataacagtgatagtcctcctgcatccaataaacaaacgcacttcttgatcattgacaattcttcagctctctttaagcattgatctttagtccttattaatttctcatagtgtcctgcttggcccccataagtccatttcatcatttaagtatatggccttgccacttccttccccacaagtagactttggccatttctatggatgcagcatttagaaaagatttgctttagcccttaattttcagaatcataaagcacatcaataattttttcacctccaagccaccccttcacaccaccttcatgtgggctgaccaagcagtgggccattcaggagtcaggcagttgctgttccttgttaggagaagtagaaagccatgaccccagcattgatatcaaatcttttaaatattggttatggggtattttgacttttatcttgtttgattcttttttttttttttatttccaatcactgttttgataaaaatgtgttaattatatgcttctgtttaagagtcatgatgttactcttctgttgatggacctgcaaacttcatttattataagacaatgagaagttattattctccctaagaaagctagcttagcattcattttaagaatactgaagaaaactttgattctctaactagaaaagagagattaaaagtatttaaaagtacaaaggaagttttttccctctcaggcctctcttggttcctggtttgttgttgttgttgttgttttttctaatgctgcttcagttaacaatgccttgtgctggtatgctattttttaaatgcaatggagggaacagatagatcttcattcttcctaagagtagaaaattctcattatggagactcataatcttcaatatttgaagactatattcacaccagatcagaataatgataagttaagcagaattgaaacatattgaaatcatatttgacactggaaattctttaattctatgagaactatatcattatagttctcattttataagaaagttatttaatatattttaaggatgataatagcacattgtgcgttaactttgatgtctctttctttgacagtttggagactacattggcttgcaatggagaataaaatctcaaccatattaatgggatcatcttttattctccaaggcctaagtagtttccagggcacatgatgccccttatagatcctcatttgtccttacagtgtcttcattctggaatgtgtaactaaagtaaattccaaaagtaaatgttaaagaatcatttttaaaaccaagtaaaataatgaccctcatgctgatataaaatgaacacatattaaatatttaactcattaatgtaggaaccaataagatgttgtaagttcaaaggagaattcaaagaacagacttaattatagattaggaatattgaaaaaaatgtgaaaattgaaggaaaactggcctgggccatggtggaaaaaggaagccaattgaaatcctgtcagacagaatgttgcatttctataggaatattattttttgcattgctaatggctattgacaacttacagatttgtaaaatggctcaatgcaaggttggaatgagatttcctggaataatgtaccgtagacaatgcagttttccctgaataacacatttttcccctacagtacattgttccctctttattggataactagtatttaccattaagattttgctcaagcatgtaccataagaagccttccctggtaccttctgtctgtttttaggtttccctctacctctcaaaatagcttataaataacaatcactggtctctatacatggcattataattccatatttatgatttccctcagtccttcttctttaagaccagaactatacctttttattttatttttgcatagtatttgtatagtgttagacacctagacaaaattgacaagttgcctacagaatgaatgagtgaatgaatcaagtagtgatggatgtatgcttgtgtcaaatttacatgagcatgtgtgataggaaaacatttgtcatgcaggatgcatcagggatttgagcatggtccctttaactctgagcattgcacagctcatatcattactaaattaaactctatgcttacctgactttgctacaaccttactctctgatcccagaaaaattctgtataccttgaaactaatttatattagtgaaatacatattctttattcttgcaaaactgcctgtgaaaatgttttttaatcataggtcatttgacattatagtaatatatttgcaaaagtggaaagttttgcataagcacaagtaatgatctttaactaccttagaaatgatttaaagtaggtggtcaaagaatctttacttttctggtatttctggcattatggcaaaagcaacgaagcaagagctagttccttctctttacttccttcctgtaatctttgcaggttctttgtacatgttaggaaataaacctttattagttgaatctctaatctgttagtacattttttaaattacttagcattaagtctataatgagtagacagagaccatatacatgacccattatttaaaggttcttaaatttcagatatgtttacacaaaattgtgcttcttccgaatccttatttcagatgattcttgtttgaatatatgttggcacctgtatgttcaaaacagtggaggtgtcttggaaaccgcaagatgcatcctgcaaaaaggtagagggtggtagagagtgtcctgagttttaaataagtagatttttggatttgaatttgagctctgtcaatttctatatgcatgacctgaagcaagctacttaatttctttctatttcattttccttatatctaaaatgagaataataatcctgatttcatagagctgaggtgagggtaaggcagacaatgaatgcaactgacttatgaaagcaactggggaatgcattcattccccagccattccctggagtacaccttgttttatctgcatttgttcatccctgtttcttactccttgtcagtcaccaccttctttaaatccttcatggttgagcttaaaacccacccgttcctgccttgttgattggtttttcttgtcactgccaagtagactgtgggctcagtgagagcagaggctctgctctgacttgttgagagaccccagagcacctcctacggtctggcagcccacacccagtggactaaaatgcagccctggcaccatctttctatacttcttttctcagaggtgttgcctcattttgacctgtgttctctagaaacccaagaaattttctctaaagaacagacttaaagtgaatatagtttactccgtgctgttcatggttctgaatagagttggcgcatatatagtgggtttgattttctttaccaagctgccctgtagttcgagcagcttgcacatatgcttccagatagactcgcccagcatgccttccagaatccaatacagcttcagaattccagagagtgaggactgacctagggtcaaatgcattaacctgctccatcaccaaaatgctgctggaggattgaacagatgtgtgtcaatgcttgtggtatcagtaaaacatacgaaaacatggatttattttaactccctgtggtctgaagctgtaaggtagagatacaaaaattcatacactgtgattttttttgctgttattttcttcttcacagtgtatttattccttctgagcatctttggccatgcactgtgttttctttaatgaaagtagaaaatttgtatcctcattgcttatttttagcactgttgctatgataaactgtagcctaggcatcttattaaaatcaattgaggatttgaattattattccctttaatattgtggcattactattctttctgaaaatatttcaccatgtatgaatctatccaaatatttcctatgacttactggaaagatatttctcatctatttaagggatatataaaaaatagcctcataggggttggggacaaatgtttttgttttcctctggattgtttttgtgggaaagtgttaggtgcaattatttttttcaatactctgcttaagaataatttgtaatatctttaggatgaagttgcatagtacaaaacaactttttgtgaataaagtaattgacaattttggttttaattaccacatgtcatgactagtagacttcctaacaaaacacatagattgggcaacctgaatttttctacataaaaattgaggtcttacaatatcatgaggtcttacaatatcagtgaagcaataatctgcattccaagactttatgctgtttcacatgtgtaaatagcaactacagcatctactatttctgccatggagtctgggactgtttcaaggctgttcatctatgattttcattctcagtaccaggatcatgggcaggaatggagcttgaagagatctgggcccactcacaagggtttttaagaatcaggagatggtaattattaagaggaggtaagaactgagttgaacctaaagggtcgacttatattttaggctgttagaccagaattatacctccctttaaactagataaacatactagcataaaacaacctgcagtgatgaaggggaggccattaaacccaaagagtcctagttctaggccaagtgttaggctatctgctttcgtaagtacatcccatttaatcttcctaacaaccctgctaggcacaagttattatccccatttcacagatgaagaaaccaggctcggggagattaaataacttcctcgttgtaaggggttgcactggcatttaagcttagcccttatgattcaaagcttatgctttatgttatatgatgctaaaataaaggcatggtttttttcccatggaagaatatccttcatattttttaaagttgtagtaagtagcacataaatgagacctactcttaagaaattttataagtgtatagtacagcattaactataagcacagtgttatatagcagttctctagaacttttgtaacttgcatgactgaaactctatacccattgaatagaaactctccataggtctttacatctataactaaattctgatcacccattcctgtcccggcactgcttatttgtttgttggttttgttttgtatagagggggaaaggtgccacattaatgccgagttcaaggtcactgtttaacgaacaggtcttggggtagcaattgctataacatgtcaatagccagattcaccataaaggtgatcagactactaccacgctgttttattaatcactgtatgaatttgattataatttataatcaccaacatagtttctgttccatttaggtgacagactgttgatttactttgaattccaagatgacagtgcccctctgagtcaggcagggtatattttaagtcacagttacttgagaagtccctccccaaagcagatcacagacatcacttcttcatctggttgagaagcttctggatggagtcagactgcctggcagatcctggctgcactccagagaactatgagcactgccagacagccccctggcactagggctggccaaacagtcatggcacaaggatcctctgtacttttactgggcaccaagcccagctccatcagggcagaatgtggagctcagcagtttgaagtctggtctccatggcactagggccaaaggcaagctacagaaattccaaggcaactgcattgtctctggtgtaggcacatgacacattccacccaaaaaattaagagaggctgtatcctgtccctgatccaaggtaggaagaaaattctctccttttcccttctttgttcacattattcaaattgctttcaaacggtttgaaaaatcgatttttttctaataaactcatggtcttttaaacaggtctaacagcattggcaggatctcatatgaatgagcacagtactagaagacatcacgatgaggccttattccaacttcaggttgcagtgtgttttcaacatggcacttaaacttggtgaacctcagttttctcttattttaattacaatattcatggcatctgcctcacacgggctttccagggttgttttgagaactaaggggaaaactgtgtgttcaagaatttggcaaactggggacatagtgtgtgtatgccatgtttatgaatactcctaagtaagtcaacttcgtaagggttgggtctctgtggcatacagaaggtgctcatgaatgcctcaaaagtcgtggaaaggaatcttagtgtggggaggggggagagagagagagagagcaaaaaaagaagaaagaattcaaatctcggaaaacccaaatatgcttttgaaattagtaatctacacccagtaaaaatcttaaaatcttgcttttgttcattatgggatacccaagagatttaatctttcactaattgtttaaaaatcttttataaactgaaagcacacccaacattaagagttctgagcattctgaattacttacatttgtaaaattccttttgaaaaatgtaaaccaagcttatttcataatggtttcttcaaatcactttttcctattgtagtgtcctttactgtctatacacgggatcacatgttaatagtaccaactgtcctgagccctttccaaacaccaggctgtatctaaccctttatcataagatgtctcattgacttctcattgcaaccctaagatggtcatttttaccattttacccactttgcagttgaagctggttggagcagttacataactcaagaaaaggggcaatgctcataagtaagaagatgaggactcaatttcagactactagaagtcacaacccatgagttttgttttgttttttcttcaaagagccattcaagactccatttgccaagcctagacatggcttttatggagtgaatttgatctttattaatagctggaggcactgcataaaaggaacttctggccagagcctagtggtagttaatcccagtgacccagcctcattcattcatctgtttgcttctgggactaccacctgaacatttgttttgtcttggcttcttccctgcagcttgatacttcacatgtgtctctgttctgtctctcccagttcatcaaactggtttctgtcatcctcttttccatgtttgacttcttgagcactccacttgtcctccctgatcaacactagcctagtgaggaagagagaggccatgtattctattttcaggttgttttatgaagcagttaggccccactgagctcagaggagtgtgctaaggaagtctatggaaacaatgcacagttgtataattttgttttgaaatgtgttctgataatactttttcaggcatcaaagttgcctaatccctaaaaatatacaggtgtattatataaagaggataagatattatgcagcttaaactcctggaaaagttctcattagttatattttacaaccaagttccaatgcgaagcagcctgtttgtgagtgatgattagcgctgccaatgccccagcagtagcaggaaagaatgtcatgaaatgatccaacttccattagaaaataatgactgtcttggctgagcaacattttttaaattaaataccaacaattcctagtaatcagagagcctattagccatgaaattcgatttcagtatcagagactattcacttaccaaatgggagccaaataattgtgagtggaatttacagtgccgcattggggatagtagtaaatattatggaagtggcactagggtatagcttcagctctggggaaatgtggcattttaaaatttcagtagcaagttagtgtgatgattaacagaatgcagtcattaatttccaaggcatgatattttctctttagtcatttgagaacccaaggtcttacagtgaactcgtcattaattgctacttagcttcactgggcttttccaaatgtccatcagctcccttgagataaaatcaggaatctttgcattagaattagccttaatttatggagggaggtgttcttgatcccaggagtgatctttaggaagactggaaaataagtttatcatttctgccagctcaggtctaagtattctctcttcttttcacatggtctctcctgacgcatcactgcccaggtcacctcttcaatccttcctcattctttgcaatccctgttcagggatatgggaagaaagtattcactatctacttctgccatgaattgtgtcaagtaacccagacacaaatagtggaagtatattattaagcaggcccatgtagattaaatactgctccacagcacaaagttaataagggttaagaaggaggattcatacctaggtctatcctcagaacacttgttctttacattattgcactatggaaataaaagttgataaaattttaggtgaatacattgctctgccattttctaatttcgttttaatacattttgaaggaaacttaagcttggaaattaatgttttccacatgcagcactaaattccaccaccgtctttcaacagtacaaatccaatggaggaactttcagtatttttcaaacatatatatacatccatgcatatgtatacatgtatagtatacacaaatatacccatatgtatacacatgcacacacaaacacagacatatatacatatatatacacttatatacatatatgttatatatacaatatatatgtaatatgtaatctttcataatatctttcttttttatccatgaggactgaactttgcctaactgaaaaatctctctcttggcacccatatatgtgtctctacaaacttgttggcaaactgtatactggcacatgcattctacaagaccaccaggctcaaaagcagaacatttggcggatagaaactgcagtggcaggctttctaaagaataaggcaggagaagaaccccacagagatgcatggagaagataaaacaatttgtctgttgtcacaccctaggaagggtcaagccaggcattcaatccatacttagctggtcccaaagtccatattctgtccactacattaacctgctgctgtcagaaaaagaaaatgacagatttatagttctcctctccctgccccagtatatgtcagcatttttaggtatatttgaacaaaaactgaagttcatgcatgtcaattgttcttctaaaagccttcttagtggaaacatagggaaacatggcctttagacatgcccaaagtgaacacatttgttagaaaactcagtgttatgatgtatcatttagagttaacaggtaaaacattgcatatcagctgattttaggaaggaccaaatgccatgcatatttctgccatgagtgctttttacttgccatagtgggccataagtaattaaactatgtcattcgcatttgaaaataccatgactacaggccttacaaatagtctccttcctaagttctgtggctgttagaatctgggaattgacattgtttctttttttgtaaggagtccttatggctttcagatcccttactggaattcttgccacaagagggatactgagcagtgaaggtttacaagtctcccttgcgcttgtgcatatggattaacttcactcttttaataccttacttctccatcagttctagagcccactgtgagctgaggtgaaggcacattttccctcccaacaggaaagtgaccaatattatatttacttcctggggcaaatggctttctgtcagctttacttgtaaatctgcctcattctactggatctatctctaaacctaattgcttgcatactgcccaaagccacctttgggagctatttgtgaagactttgtctcatttgtaagctacaaagtctccaaaacacatattttccctcataatcagaggttgtttttgctttggtcaggaacaacattcctcaaaatatctgtagggggctaataagtcacaaagtgttcctgagtagaccaggaggtgtatgacaaagatctatgtctttctccctccttctatccttctctctcccttcacccttccttccttctttccttcttttcttcctttttgccatatgaaagaagaatggtctactgatctctctctctctctctctgtctatttcattaaatggcattgcattgcaatcttcccaacaaccaaagtcagagttgaagatcattcagtccaatctccttattttacagttaaaaaacaaaaacacaaaacacaaaactaccccagatgggcgaaatgacttgatcaagtcacatagtattgggcctagggcctgaacccagattctttgagtccaagtacagtttacttttaggtagttagagatataaagtggccactgagatacagtgcaatagaggatttccggctttttccccatccaaaataatctcagtcaaagacagtttgagggaatatactgattttgaacacgaaaccaaaattatagagaacagaatttttttaaaaaaatttgagtatatttaatttattgaaaaatttaaattggatattatttgtttttgttgcttttatttccaatggcgatggcatttggaactgaaatttaaaatgtaggattaggaagtagctttcacatttatctttattttttgcaaatacctatgcatatacatagattttcaactatgttttcataggatttaatggaaattgtcaaaaatgtctcaagatagttatgatttttaaatgttatgtttagaattactgatcaatttatgatcaaaactgcaaacagtaattgtaaatattttgaagttggtgctactgtatttttccccactatttgctactctgattcttaaatttaatggactcatgttgaagacaaagtatttacagttataaacacataatacatttagaattgtcaatggaagcttgactttttctcacaggatggttcattgtggttaagacttcattagcatcagtaatgtgtaggaaacttaacctctcattttcaaatgaaaagtgttcagaatttttcaactattaggctgtttgagttatctgtgctagacatttcttgtgatatttttgtcatttagtttttatctgtttttaatatcaagggaaagtgaatgctaggtcaacgtattttgaataaaattatagacaaaaccttttgagtaataattatgtagtaggatgcaaactgacacataatggcaacattcgcaaaacattttattagagattttttcctaagaggacatgaaattttggcattatttttattctgctatatttgtcattagatatgtagacagtttcatgcctgctcatttaaaatgtatgagaatctgtagcagtgtcactggtccctgggaaataaatgatgtcattaaaataacattaggactttgagcttcttaaacccagaattattatctttaagtgaggacagctgcatggcagaaaatgttgatgagtctcttagtgcttaattcaagtgttgtgtgatggttttcctgtacaaatctacactatattgatagtacctgagagggaagaaaacaaataagcaagttcaagcttatgaactactacatttctccacacttaagtgtgtcttatttcttacctcaatcaaatattagttggctcagaataaaacttttttttaaaaaaagctaaaattatctctttgctttgcttgttcttgtggtactactgtttcaaaaagtcattatttagtgataaatatatttgtgttcagggctgttattttaagttagaagagtagaatatgtagttctttttatcaaataatcccagtccttaacttcttaattttgatcaatttctgtttgggtagtgaatatatttggagtatttttgcacactggagaatcatcctgtcacctccacacatggaataacataggtaggtataacactctggtccatttctgggcagttgctttgctttatattatatatttttgatgatctaatgcttgtaatacagtaagtcctcacttaacatagttaataggatcttggaaactgcaactttaagtcataccacaaaattggttttgacatataacaaaaccagttttaccataagctaattgatataaacaacagttaagttcctgctgcatatttctggtgtacaaaacatcaccaaacttctaaataaataccaaagctcttctaatattaaacattgaagtaaagtgttatctgtatatacatttaagatagactaataaaaacaagtaaggtaattgtttatttcatttttggtgaatgagtgagcgacagtgattgtttgtattggtggtgagtttaatccaggaatgaaggtttgcaaagtgaaaattgtcagggacgcttcctaccaccacacagttaacaattacaaatatggtgagctaaccgagagcttctgtaccacataagtttattgttgagcatgtgtatgattatcatatactttatgaagttttgctttacaataatttgtatttattaattcactttccaactctctcactgtagttcagggttgcaggtggccagatcctatttcaggagctcatggggcaaggcagcacctaaccgtggacaggatacccttccatcatagggcacactcacccacatacccacactcactcaggctggaacaatgtagacatgccaacaaaactaacatgcacatctaagggatgtgagagaaaacaagaatatccagagaaaaaccatgcagacatggagagaacatgccaacaccacatagacagcgaccccagctggaaatcagtgtttttcccccattaacatcataacgaaataattttttttaatttttattttattattattatactttaagttttagggtacatgtgcacaatgtgcaggttagttacatatgtatacatgtgccatgctggtgtgctgcacctattaactcttcatttagcattaggtatatctcctaatgctatccctccctgctctccccaccccacagagtgtgatgttccccttcctgtgtccatgtgttctcattgttcaactcccacctatgagtgagaacatgaagtgtttggttttttgtccttgcgatagtttactgagaatgatgatttccaatttcatccatgtccctacaaaggatatgaactcatcattttttatggctgcataatattccatggtgtacatgtgccacattttcttaatcaagtctatcattgttggacatttgggttggttccaagtctttgctattgtgaatagtgcctcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatatcactgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttctttgtagattctggatattagccctttgtcagatgagtaggttgtgagaattttctcccattttgtaggttgcctgttcactctgttggtagtttcttttgctgtgcagaagctctttagtttaattagatcccatttgtcaattatggcttttgttgccattgcttttggtgttttagacatgaagtccttgcccatgcctatgtcctgaatggtaatgcctaggttttcttctagggtttttatggttttaggtctaatgtttaagtctttattccatcttgaattaatttttgtataaggtgtaaagaagagatccagtttcagctttctacatatggctagccagttttcccagcaccatttattaaatagggaatcctttccccatttcttgtttttgtcaggtttgtcaaagatcagatggttgtagatatgcggtgttatttctaagggctctgttctgttccattgatttatatctctgttttggtaccagtaccatgctgttttggttactgtagtcttgtagtatagtttgaagtcaggtagcgtgatgcctccaggtttgttcttttggcttaggattgacttggcaatgtgggctcttttttggttccatatgaactttaaagtagttttttccaattctgtgaagaaagtcattggtagctttatggggatggcattgaatctataaattaccttgggcagcatggccattttcatgatattgattcttcttacccatgagcatggaatgttcttccatttctttgtatcctcttttatttccttgagcagtggtttgtagttctccttgaagaggtccttcatgtcccttgtaaattggattcctaggtattatattctctttgaagcaattgtgaatgggagttcactcatgatttggctctctatttgtctgttattggtgtgtaagaatgcttgtgatttttgtacattgattttgtatcctgagactttgctgaagttgcttatcagcttaaggagattttgggctgagacgatggggttttctatatatacaatcatgtcatctgcaaacagggacaatttgacgtcctcttttcctaattgaataccctttatttccttcttctgcctaatttccctggccagaacttccaacactatgttgaataggagtggtgagggagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtctttggttctgtttatatgctggattacatttatcgatttgtgtatattgaaccagccttgcatcccagggatgaagcccacttgatcatagtggataagctttttgatgtgctgctggattcggtttgtcagtattttactgaggatttttgcatcaatgttcatcaaggatattggtctaaaattctctttcttggttgtgtctctgccaggctttggtatcaggatgatgctggcctcataaaatgagttagggaggattccctctttttctattgattggaatagtttcagaaggaatgttaccagttcctccttgtacctctggtagaattcggctgtgaatccatctggtcctggactccttttggttggtaagctattgattattgccacaatttcagagaacgccacaaagatactcctcgagaagagcaactccaagacacatgattgtcagattcaccaaagttgaaatgaaggagaaaatgttaagggcagccagagagaaaggtcgggttacccacaaagggaagcccatcagactaacagcggatctctaggcagaacctctacaagccagaagagagtgggggacaatattcaacattcttaaaggaaagaattttcaacccagaatttcatatccagccaaactaagcttcataagcgaaggagaaataaaatactttacagacaagcaaatgttgagagattttgtcaccaccaggcctgccctaaaagagctcctgaaggaagcactaatcatggaaaggaacaaccagtaccagctgccgcaaaatcatgccaaaatgtaaagaccatcgagactaggaagaaactgcatcaactaatgagcaaaacaaccagctaacatcataatgacaggttcaaattcacacataacaatattaactttaaatgtaaatggactaaatgctccaattaaaagacacagactggcaaattggatagagtcaatacccatcagtgtgctatattcaggaaacccatctcacatgcagagacgcacataggctcaaaataaaaggatggaggaagatctaccaagcaaatggaaaacaaaaaaaggcaggggttgcaatcctcatctctgataaaacagagtttaaaccaacaaagatcaaaagagacaaagaaggccattacataatggtaaagggatcaattaaacaagaagagctaactatcctgaatatatatgcacccaatacaggagcacccagtttcataaagcaagtcctgagtgacctacaaagagacttagactcccacacaataataatgggagactttaacaccccactgtcaacattagacagatcaacgagacagaaagttaacaaggatacccaggaattgagctcagctctgcaccaagaggacctaatagacatctacagaactctccaccccaaatcaacagaatatacatttttttcagcaccacaccacacctattccaaaattgaccacatagttggaagtaaagctctcctcagcaaacgtaaaagaacagaaattataacaaactgtctctcagaccacagtgcaatcaaactagaactcaggattaagagactcactcaaaaccgcacaactacgtggaaactgaacaacctgctcctgaatgactactgggtacataacgaaatgaaggcagaaataaagatgttctttgaaaccaacgagaacgaagacacaacataccagaatctctgggacacattcaaagcagtgtgtagagggaaatttatagcactaaatgcccacaagagaaagcaggaaagatccaaaactgacaccctaacatcacaattaaaataattagaaaagcaagagcgaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccagcgatcccacagaaatacaaactaccaacagagaatactacaaacaactacacaaataaactagaaaatctagaagaaatggataaattcctcgacacatacaccctcccaggactaaaccaggaagaagttgaatctctgaatagaccactataacaaaataatgttattcaaagttcatctgacatgctttttcatttattcttcgtacggtataggaagaataagtatatgctttttatgatatacttaggtcttttctcaggttaggaaactcttcttcaagtaaggctttgataattgtttcactgcaaagattgctgccttattttttagatttggatgtctgttgtctgcattcaacatcaatcataagaggacccttcatcattttcaccttgtgtgttttagatagctcaagtagtttctatataacactcctcatatattgctttggatacattctgtttcttaatgtttccaatgggtgttattttttctgctgttgcagttagagcttccttaaatcctacttctttacatttaaaaaacaattataagggggctgccaagtaactttccaaaattttctcttagctcctattgaaagctattttcaaagataactgttccccaagactttatgttgtttctgctttttcttttctttccagagtttttggatttttatgtgagatttttgtgtacatttagattgcagtgagaaaagcccattccaaaccccatgtttttcaaaagagagggtctatggagaacccttgggcactctctgcatccaattggatgctggtcaaatttctgtctcatatcaatagctgcaatagatggatatgagtagcccagagctcagtttaaaagcaccaagctgacattcatctcgtgtgaccctgctggtttgagatgaacccataaaatccataaaattaaaaatctcaataatcatagcccctaggaatctaagaattgtttatttcctgttgtgcctatagtgttgaatttgcaggaatgacttattgtagaacagaatatgtttcattttctgtaccatcccctattatccaccccacacactcaccagcaacatatggtcttcctttccagtgttttctctgaaacttcagttctgaacagatatgctaagatggataagcagtgatggggctgaaggagagcgatgctttaactgcactttgtgttcaaggagtggaatattcagacatgttagactgagtattaaatgttcaccaagtcacttcaacctcatccttcatttttaattttcttcatacattactgtcagaaattattctgtttaattatagattggtgcaaaagtaattgaggtttttgccatcaccttcaatggcaaaacctgcaattacttttgcacccaagtaatattttattataaaccacagcacatagtgcattctcaacaaatgttgctgttgggatgcaggaatggatggatgaatagatgaatgggtggctggctggctgaatggattggtggatggatgggtagttgttcaggattctcattggtatgggatttgtgctgttagtctgtgtgtcctgcagactaacggcacaaagaaagatagaaggtcttgctacctgctctcagactggtataactcacattatttggcaatacagagactctcagtcttagtttttattgggagtgtaaattttgcctctttgctatgccttcgtagacattttggtggaaagtggtgacagacagtgtcacaggctgccaaccaggtaccactttaaccaccaagactctgataatgtctcgtttcctcctcccatctctaccccttgcttcctctcagactcctcctactctctgtctctccagccatgcctccacttgcagaatatccttctctctacccaccgttcatctttaccctggtcatttctttagccacgtcctcatgcgtatccagcatttctatcctgctgtgtcaaatataagacacattctttaactttagagggaatttatattttctcgtctgtagttttctggaaatagtggggaggttgtaggctgtgatcaatttgggagccatttaatggcagtaaaatgggcaaagcaatatatcgagaattcttcaaattgatatttatctattttcatccagccttaggtattttaatacagatacaacttttactaccagcaaactatagttagtaattgattttttgcttcctatttcaaaagctacagataaaaggacattaatttttaagaggccactcaatcagaaaatgcattcttcacttagagtggtcaaaagagcagtggagtggaactcaggaaaccagaggactagctctgactctgccacttacattgtttgaagcaaggtatttctgttagggacctccatgggccttcactctaaccaacttttctgtcaccttcatgtactaagagtctctgatcccgtgaggatgacgtctacttgcccatcactgctcctacctgaaacccaaatgtgccgaagtttggatcccagcacaggctcagcatcatcatggatgatcagctcatagtcctagaactggctgtggagacttttctgaatatgaacattgtttttaaatcagtgttagtaaacatggactcaatatttacttgaaaagaattatttcagttacagattgatgtagttcattttaaccaccttgtgtatgaaggatgaaaaatgagtgatctagttttgaagtaactacaaaaattgtgtttgtatcaactgtcctgtttatttttgcttgtcataatgagaggacatcattattaaatctaaattatctccaccacagtgtcactaaatatgatcagtcaactatctctgcttcctttacttgagatctgttgaactaaggtcaaactgagctcaagcttctcatccagattatggcaatacacacctttccccaccaattgttctttaaagcattgtgagttggcttagcaatgtcttcttccatctaaaggtgggtcacagcactggcaaatgtataatgttggactattgctgggagccacataccgcattagatttttttttttttttggtacgctaacagctcctcattttctggcaatgtatgacaggcagaactgtaatagttatcctcataagcaatgtgcaagttagataattgcaatactaaacacaatgaatattcagtttgtttaggggcactgcagtgaaaaaaagaaatgcatgtagttgtgatctacctgtctcaccaaaactcacatttagtctttcctaaaaatacctgaacttcattaacatcaacttcaccagtactctttcagatgactgcatattgaattaggctgaagggaaggggaacagtagcccatggggtcatatcagacttgtaattctgctctttccaaaagacttacagtgacagccaaccacattccaagaactgcactggtcaccagagatgcaggaggaatgggccatcatttctgtgcccaaggagctcacacagactgtaattacctctgggaatctcaaagaccaaagcaatgtgaaattttgtccacattgttctcaatagtgactgagctattctatatttgttccctgatctgttttaagaatgaaaatatagagaaattagagttcaggtgagaagagttaaagtgattaagaggatggtgaactcttctaacaagaaactaatagcgtgtagcttagttcaacagtggtaagtggagctcatgataatgatatataaatgtttgaaaaatataaacaagaaggggcaacattgtttagtattattcaattacaagtgattaatagcaatgcaaagtaattatgaaagggaaattaaaaatggacataaggaaaaaaagttttcttttggtcttgtttcctaaaagaaaatatagggctacattataggaaagcatttgcaactacacaagaaaatatgaaacaagcaagctaagagcaagtaatttaccaatggtagactaattattttattaattcattattaataaaatttattaattcatttatcaaatgtttttattcattcatttatcaaattaattattcatcaaatgttttaggttactcacctatttaacattttctttgctcccatgtattcatgtatttcatttgattatttttttttttaacatttcagtgttccaaaaattgggagacataggcagtaatatattttttaggaaaatactggtggttgtaataaataatctgatatttcagtagtccaacacattaaaagtttggttctcattcatataaagtccaaatcaagtgtttattaaaggcagaaggatgagggttggattgtgggagtcgatggttggaggggcccagatccatgtaatcattcagagatccgggctgaggaagatccataaattcactgtgatctccacagccagctggaagataagagcagaaagagactgaggaagaagtaactcctccttacacactcggttccagaagacactcagatcagtttcacctatattccattgttgagaattcatggaatgacattgcttggatgcactgggcattgggaaatgtggcttctttcctagcatcatctctacaactttcaggagagcatgagtttttaatggacaaacaggtgaataaaacacactcaaattcctggcctcttggaaaatacattttagttggaggaaactgatagtaatactataaaatcataagtgaaataaacattttttttgtaaggacataaacattgtgatggtatgtaaagcctggaagaagtgcagggagtgttgggtgtgcaattttaaatggatagtttggaaggagctcagtggaaaagaggtatttgagcaattatttgaatgaggtgagaatgtaaatcatgtggaatgtaacgggaaattatttaaagctgcagcgcagcaaatggaaagctcatggggtggaatcatgtctgatatctttagggaacagctggtggctaacctattaggagcaaagtaagcaaaggttagagaatggtaggatatgaggtcggagaagtaatagggttctaaacatacagaggccttaagagtgacagtgagaattttggctcttactctgaggtacaggggaagtcattagagggtattgtacagaggagtgaagtgatttgatttatgttttaaaaggattactctagttgttgttctgaaaatagactgtggtgcagtaaggcagaaggagggagaccattagaaagctttttcaataattgaggtgagaaatgatgacagcttagaccagagatattgagaagtggctggattctgggtatattttgaaggtggaagtgacaggatttgctcatggcttagtggtaaggtgtgatggaggaaaggagtcaaggatgactcgaagactttgtgcataaaagactaagtggaagagtaggatttttattaattgagatggggaggactgtacaggattctcatttagatgtgggtggagcacataagggtcttgatttggaatgacttttagatatttaagttgagctgacaagtaggcagttagatatatgaatatggtattggcatggggaatggaggaatagatccaaatattgagctccaagggactccaatatttagaggctggagaagtggggaggaaccagcaaaggggaatgaaaacgagtgacaagagaaagaaaatcagaaaagtctagtattgagaaagccaaggaagagaagtgtttgaattaagaaagaatgaggctgagccaggaggatctcttgagcccacgagttagagaccagcctaggaaatacagtgacaccccagatctataaaaaaaaatagccaggtgtggtggtgtgtgcctgtagtcccagctactaaggaggctgaggcaggaggattgcttgaacatgtgaaatataacgggaagttcaaggttacagtgagctagatcataccagcacactctagcctgggtgacagcacaagactctgtctctcttaaaacaaatcaaagaaagaaagaaaggaaagaagggaaaagaagaaagaaaagaaaggaaaagaacagaaaagaaaagcaaaaaggaaggaaaaaagagccacagtctcagctgctgctgacaggtcaaataaaatgaaatagagaggtcattggtgatcttgatgaaaaaagaaaaaagaagccgagcgcggtggctcactcctgtaatcccagcactttgggaggccgaggcgagcagatcgaggtcaggagatcgagacaatcctggctaacacagtgaaaacccatctctactaaaaatacaaaaaaaatagccaggcatggtgacaggcgcctgtaatctcagctactcgggaggctgaggcaggagaatggcctgaacccagaaggcagagtttgcagtgaaccaagattgcaccactgccctccagcctgggcgacagagtgagactccgtctcaaaaaaaaaaaaaaaagaacaacaacaaaaaacagttttagtgtagtgatgagcaaaaactgactggagtgaggtaaagagaaaatggaaaaaggcaaattggtggtaattatttaatttttttatctaattgttttgaggattttttctataaaaggagcaaagagcaaagtgatagggtgataattagaataggaagtagacacaaggaagggatttcaaaatgggaaaaatgacagcacatttgtaaagcgatgaaaaatttacaatgcaagaaagagaaggggagttaatatgcaacaatcttatgtcgatgagaagggctggaacaggcactctagtgaagggactggagataaaggcaggtttatctgtaatggttcagattaaggagtgaaatgcatggtaggcttgtgtgagttccctttgaatttctccttttgttcttaggaaataagaagcacaggtcattcagaggagaagatgtgaaatcattctttaagggaataggatagtgaatggaaaacggaaatcttcccaggcagtttcgaagaccacttgaggctaatggtcatgtgtggaaagcaaaatcattcaaccttgtgccttttaaaaaattttgtcccatcatagtacctgtgtgggagtgtgactatagcataatggagaattttgtttagcgagttagacattttttcttggtcagtacaatggcatgagagatggttaaggagtttaatacttgagcaagagaattattaaaacagcatgctggagattctaagcttggtcaggtgggtgtgatgactttaaagagttgaatatggtagtaaaatggtgaaaggattagtgtatttgaaaaaaaaaattagtgttatgctactgaaaggaatgccataggctcactctgataggaatctttgaagctaaaaggatggagtggttagttgttggtaatgagaagatttagatacaattatagaagtgaggggctaaagatgattgcagaataaagccacaggaaatcaaagaatggagaggctgaagtattggaaggatcgtcaaacttgtttaaatctgagaattttgacaggaacagtgtagatgtgacacagagccaggaactacagtcttacagctatgacattccatctgggatttttcaagtatctcattgaaattttcttttttaacagtctagttggggttagctctgagtttttgtttaaatagaaatgtttttattttgactgtagctttcaaagatgcttttctggctagaattccaggttaacaattatgttctcttagcattttcgaaatattgttccattgctttctgacttttgtgtttgctattgagaagccagtagtctaattattgtttattgtggatgactttttttcccacagctgttttttaaaacttctatttatttttacactgcaatttcagtaggatttatctacgtgtagaattcacaaccttctgattctgatcattgttatctctcattaattctggaaaattcccatgaatttttactccaaataatcattgtctttattttctattaggattttgcactttatactgcttgttggatctttccactctattatcctttccttaaaatatttctttcctattttccatcaccccttatatgtgtacttcatttcttgtattttcttcagatattttttcaatgtactaattttcctttaagccatatctgatagtctttttaacgttacatttttcatttctatagagttatttggttctttatcaaatacgtatgtataattttgttagttcttttttcctaactcctactccaatttctgttatttatttaaacatgttacacatgcatgatttatagtctctgtgtcataagtccaatatctgttgttctttggtgtttaattctgtggtatgttggttctgcctacacgtatacatggcagcttatttcctcatttgtataataattttttaaattcttttgatctttgatcctttgaaattgttggggtaatttttaggctacatttaaattgtcttcagaaaggatttctaggctactttcagataactagaggccttagcaatctataactactttaaattatactttaagtttgggtggggagtggacaagggtatgataaattttgtttcaaacatgagggcaaatttttgtttaagaattatcaagagagttctccttctccttcactgcctcctcttcgtccttcttcgtatctactttaggccaaagctaggaccttcattctaaatgagttaccatgtatcagggattcaagatactcacagggagtcttcaatctggccttctaccttagttccttatttgcatggccgactaaaactcagactccgggccaccagtgattggcatataaactgaagaaaacttcccattctagtgcttgcttactcatgtggattctctctttctttcctttcttttttttttttttctttgtaaagccttctaaagaattcccttactctcctgtgactacagtcgtgcattaaaaaccgattatttgatatgttatattattaattgtgctaaatgggaaataaggggtgtcatgttctggtaacatttactcaaacttttatatatacaagtctcattgggtgcttcatctttgtgttttctcttttttccagggctctatgtatattaaggatagcaattctaggccatacatagcaagttatttttttccctagtttgttatatctagttttaactttgataaaagtgctgtgtttttcttcttaagaccttttaagtttttatatagtcaaatatattgatctttccttttaagttctctgcatttgattccatgcttagaaaattgtctccgtcgataccataaaattattttttaatctgatatttcttctagttcttcctagaattaatattttcaacgacccgtttcatctgtagaatataaatgactccttttatgtggtgcagaatgcttttatgtataggtatgccttcaactttctattatattctatctatataatatatatttataaatatactttttctagaaaaaattagcttaatttaggtcatattgagtagttccatcacaagtttttttattttgatttttttcccttctccttcctttagtcatctcacaagtttttggtgttttttcctaaggaaacatggaaggtcattctactttgcctcaggccttgagaacaaaaatgaaaaagttggacacatcaaaaccctaaatctaggcactacagacaactgaagaggcagttcttatttagggtgatatattctttaatagaagatactctgcttgccatgggaacgtatataggaggtgcgtctgacctggacaatacaatcaggaaaagcttcctggcaggggtgatttgaagtctgtatttccagtatgtggggaatggtggagaaggagcaagaaagtcatgccgaggcaacatgtgggacgtttccagtgagacaaagcagaattatttgaaaaactaaaacagtagttcagttggggagaggtatacattgtgatgtgcaaatgctgcagaatgaagccggacaggaacaagggccaagcaatgaattgtggatgttttattgagagcaatgagatgcattgaaaggtttgaaactgtggaataatgtgatcaaatctgtattttttgaacaacatctaggctgtagcactttttatactggatagaaaatgacaaaacccttagagggatgggctgatttagaggatattgctgtaatgtaggtggaaagtaactatggcctagtaaatgtggaaggacacagatacactcagtagatatttcagggtgaatggccagattaggtaatgactaagatagcaaggatgggagaaaaagaagaatcaaggaggtgactaagcttttttcttgagcaactggtagattgagttaacattttctgaaaaacgtgatagaaggaggagctgtttctaggagggaaataaataatttggcaggagactttttgaactagatatctattgaataacaaagtgacaatgttccccatcctctcatttccattcccaattttacttctcgtcccaattcaaatcattcttacttatgatcggcgctatgtcagtgcctctcagctggtcttcccagacccagtacacctaatcaatccatcctacaccaggatggattcttcgctttccatacttgtggctttgtttattctgtcccctcccctgggagacccttctgcctacatatcttaaagcctatctacaaggacaccttcatgtcctaggtaccaccagtggcttctgatatgttcccttgatgatcagccataacattgtatttgaatatgttgtaacttagtatagaaatcatgggtactggacacaggcaaaaccacctctgccacttgcacggccctggaccccaaggaaatcaactgctctaaacttctgtttcctcctttaaaaatgggtgtaataataaagaccttgtttgttgtgaaggatacaattaagattggcacaatatctgactcccccacacaggaatttcatttcataaatggtaattattactcatattgtctacaaagccatttctcacagtctgttgctatagtagtcacttacgtgtctgtatctccttatatgaaggcatgagcatttcctttattgtcttcacaacaattaataaggacaagcacaatgtaggtacacaatatatggcatgcatgaatgtttaaataatgagagttactaggaggatagagaattacagaaaaaagacttgcttaaactgaaatatttcttactgtgtgccataaagtgctgaggggtgctgtcttctaccatgaatccttccagcctgaactgcaatgattttaaattttttgacagttctgttctccctaagagtagtaattttggtggttatgcatagatcaaagatgcaatagggaacgttttaagtgatgttgtaaataatgatttcaagaatgtgctttaatttttattgaatatcatctgattagcaatcttgtttttgttttagccttgtgaatatttattctagcataaatgagtacagtaatttctaatgcaaatattgtccacctgggtttcctgatgtctgtatggataattcaccttgttctttgttagtggaattattggtgcctctcaggttggaagatgcctgtactgacctacctgtggccagtagaaggtgggaagacctgcatattgcctctactcaacctctttctcccagtaactaagaagcctggactgggctggttggtgcggttcgctctttctgactctggttgtctcattcatgccagttcgggtgacacttgtgagaggaaggagttcagtctttgaggtcaggcctgtctggctcccaggcccaccactgccacttcctatgtttgcaatctggaaatagctccatatgttttttgaacccaagttgtattgttttggtttggtttcagtgtatgtaggtatgtgataatctttggtggcttacgtctgtaatgccagcactttgggaggcagaggcgggtggatcacgaggtcaggagttcaagaccagcctagccaatatggtgaaaccctgtctctactaaaagtacaaaaattagccgggcgtggtggcgggtgcctgtaatcccaactacttgggaggctgaggcagaagaatcccttcagctcaggaggcggaggttgcggtgagccaagactgcgccactgctctccagcctgggcaacagagcaagattttccctctcaaacaaaacaaaacaaaacagaaaaacaataattttaaaacaggtagggtgacccccatttactccttggagatctagttgaatttatattgttcttccaattctcaggtctgcagaatttaaaactctccccaaggtttttacagagtttccaccttggatgttctcctggtcccctctacctccagctcccgtgctgtggtcattgctgcccttcaacccatatccgtcataataagaaacttgggctttctaccagtttccttttaaaaatccacttgcatgtgtttgtagagtgagctcagtgaatgctggggtatcatgatggagtcacactgcctttaggtctttacttggatttctgttttccccctcttctcccatttctggattaagccttctctccataactgctctcttccctccttcaccttttttctgtctgtctccctcctttccttctgttctcttctttctgtcagtgtccctttctctctctctctctctctcacacacacaaacacacacacacacacacatacatctcttaaaaggatagtgatactttaccagttgatttacaaaaatttaaaagcaattatatatagaaattagtcagtgagctgcatggtgcaaatctatattggtctttccttttctttgcttttgatgaccaaagaatagctatccaaagatagctttgggttgcagctgctgccaggtatcatgcagtctggacattgggcacaatgtgtcagcagaactgggggtgatccaagcagcccgggaaacaaagccctgcttgtatctctagagtgttctttcccctgaagaggcccaaggtccctgagagctcagcatagctcatttctttattatctgccacagtcttcagtctcctctggatgccagaggggagcagattggatttctgggagagtcaacaaatagaagttctaagaattaaggcaggccgggcatggtggctcacacctgtaatcccagcagtttgggaggccaaggcaggtggatcacctgaggttaggagtttgagagcagcctggccaacatggtgaaaccccatctctactaaaaatacaaaaattagctgtgcatggtggtgtgcgcctgtagtcccagctactcaggaggctgaggcaggagaattgctctaacctggaaggcagaggttgcagtgagccaaggtcacgctactgcagtccagcctaggggcagagcaagactccatctcaaaaaaaaaagaaaaagaaaaaaaataagaattaagggaaagctggctcccaggcaatgggatggagcagaatataggggcatgagatggagaggctatgctgtctttctcccttttgatgatgctactggggaaaagtatcatcatcaaaatgtggaagggaaaccaaaaatgaagggaaggtactgaagagaaacaaaaatgtgctgaatccactcttaggaaaatgactggtctttttccttgctgtgtattcagagcatacctactgctagagctactgaatctgtgcttctggagtggtttggccatttgcagctccctcatttgaggactaatattgccattctgctgttctaagcagccattatctgccgcccaccccaccaacttgataccccattagtgttagggtacataacagtacctcagccaaggacttgagtacctccaggcaagtcactcactcaacattgtggtgtcttcttcagtgatagaatggaatacctgggcaatcccaggagtcccctccacctcaaacaattcagttcttctgtggttctacacttatgattcttttgatgagagtattcatggctgttttctcatttttatgtcactaactatcactggaaatgcattttaggtttatcatcattttacagtctcaagtttctgtttttttttctttattttataccaagacgcaaatgtgaaaaaaaaaaggaaatagaagtattacaaatatcttagcttataatagcagaccaaaagtaattggaagaaacatgagatgagaaagtataaacatatttttaacataactctgctgttctactgataaacaatttctgctgctctatttgtatagagacaatcaatatattttttagaggcaggaaaagatctttttttttttgtcagatgaaatgttgctttctaaggatagtcaatcggtgcccttaataaacccatcagcccttgtgtcttggtatagcattattggtagaggtaattatagaagctaatatttggtaactaaagaaagaaaactaaagaaactaaagaaagaaactaagctaaagaaaggaactaaagaactaaagaaaggaactaaatagctgaagaaagaactaaagaactaaagaaagaaagtaaactgggaactaaagaaagaaaaatgatgtattcaaagggagagcaagtccctcccaccatcgtttgatctatcaggtgtgatttgcctgctggcttacatcatggaaattttacttccattttttaacaacatagctgggagaacaaagaatctcaaaaacgttttagttgtagagagggtttactgccctgatgaatgactgatctgtatttctgaaaggaatcttctgcctcttatcatgatccagtcttgtattttttctcatggtgacagtgatgttgtacctcatgtcaacatgaaacataatttttcccaaacaaacttttaaagatagggaaacaacattgacatgttctggtttggaattgtatcagtgaattaaggaatggatttaaggaaagatcattagaccaagagtcaaaataactctgtggtccaatcctgcatagcttatagtcctgagatcacaggaaattcacctaagacaggatcattctagtaccatggagatttgcctggtccacctcacagggctctcatggagatccatttaagtgaaatatactaactaaaggtaatcattttcttatgaaatatcaaatatatataaaaataatatatttattataaaacaataaaaatcccattcactaatcattattgaatacacattttaaataatcatttgctgaacaaatataaagaaagcatgaagcctaggagatggtggaaaaatgacttatacgcgttgaaaaaaaaagcatcaagatgtcaatagatttgagtagctaactaaattagatataatctttgatggataaatgtaaagctatagacggacgatcaaggagtaatgcatgaagatgagatggcctgatgcacacttatgagcatttaagtacaagagaaatctgagccaagagaatgccccaaaagttcctgaagttctggtaagtgctgatggaaggggtgacccacagcctccacctggagtttagacatcccctttagctgaacattgtcctctcctgaaagtttgctgaatagtgaatttggagatagcaagaacctttatctctgtatttttaatggaagaagaattattcaaaactccaaccaaagtcctcagtatgttgaagatactcttaaatacccatataacaactattcatgcacacataaagaatttcatacatccattgccctgttatttaacacttaaacttgttctttgaaatatttgtgtgcagaagctgagcagtatcagagacaaattaaattttcatttcataacaaacatctatctcaatatactttatcattccaacttttcttctaaaataatggattttcaaggcctttaaaactcactgactttcttcaaaggctttttgacttccgtaggagacatatttacgtaaaactatgaggggaattgagagtgataatgaaaaatccatctattaatagcaagcacaagcaggagatgcttgttattagaataaaaacacatagacaattgcagaacactctgcttcctctcaccaggtctggcctgcaattagacattttcactgatgtgtataaatagagtggggtttagagtttgataataacttttaggtaaaatttattgtatatcattgtagcaaacattcgtagaatgagagtacatatagtgaaagatatatacattgtgtcagtttgtgtcactgggaaggattcactatctgccttcttaatgtgacacagtaattcaattaattgtgtaggactccagtccctggcacatagtacatgttaaaaaaaaatttgctgaattactgacagaagggggaagaatatagactactgcattggggttatcagtagagagtacataaagaaaaatgtttttaataattaaaaattctagttagaaaataaaaaaggagatagtgtgttctgtgtctctagatggacccttgcaggaggaggaatattttaggaatttcgctgaacagattcatccctagttggatttttagatgcaataaccagaaaagatcctcccaccaatccaaagtctctgattatctgttcaagaatttgtatatcccaactctttgtgtagttaaaaattataaatcaaattgctctttaatctagtttttatgtcaggaacaaaactcacatttcaatttagaaattttgcaaaggcctgttttccattgctatcatcatttttattattgtcttaacctttacttttaaaaatctatcattttaacattataatcattagaagaaatgaacgtgaactaaaatgtatgtattttgtttcatttttaatttaaccatgtcttttacaagttaatgaggatattaatttttcaaatataatttttagtttctttattttgcctaaaatctaaaaataactaccatataaaacaaatattatcttgttcactcatcttgggaatattcttagtacaagaatgtgtttatgatttaattgatgaagaatgtaaatatacatctacacatattcatatgtattaattttcatgtattatatatgcataaattaccttttcaatgtacatatgtgcatatattttgtgtaaatgtacactctgtctatcagtaaatttgtagacatgcctatgggatttgcaatctagttaagttatttcttactgttacgtacttttctgttttacttatggttaactgatgcagggaaggcagaggcaagggaccctcattttggtatcctatttgggggcctctgcaatatgtgctttctggagcctggaccatgcatactaagctttgtggactatcagaggtcctacaagcacacaatatttaaaattctataagatccatgtctgctgagtacttacctgagtgattcacttcacgaagacctgaaggaagtcaatgcaacatttatgtttccattctctctacaccagtgagtataatgttcttaggaccagtaaacattgggatcagccatatgttgggaagacaccagctagttcaccacccatggtacttagacctattcttttttttttgagtcatgattaatgaatcctatcatactggctgtcagaattctttggattcaatttgtagatacccttgtccatagactcattaagacaattttcatattagtgtgaatcaacatatataagtaacttgagtaactcctcccaagaatgcccttctacttttagctattagatcctaaatatacaaaagttaagaggctttatagaatacaactgcaaattttatttcttactatattctgttgaatttttctcagtttgattttttttaaaaaatggcaaatataacaaaccccaaaacagtggagcacttctatttcattgtcaaacccaattgacaaaaatttgaagttagtggaatttttttgaaggaaaatttatccttgaagtcatcaactattgtaattcatgctttagaaaaacaagcattaggactgaattgtattttcttttaaattcatttatgttaattattgtaaagaaattttcccactctacttttgttccccatttgctgtttgttgttgtcgtggtttgtttgcttgctttggagacagagccttgctctatcccccaggcgcaatcttgcccactgcaaccttctctccccggttcaagccattctcctgcctcagcctcccaagtagctgagattacaggttcctgccaccatgtctggctaatttttatatttttagtagagacgggttttcgccatgttggccaggctggtctcaaactgctgacctcaggtgatccgcctgccttggcctcccaaagtgttgggattataggtgtgagccaccacacctggcctgtctgtttgcactcctgctgacagcaccagtggattgctattgtgtttttcagagaggaaccaccaaatcagaactgttagacctcaaacagttgtttttgacacagagtggtggaagggagccactcaagaaaccttgctttattatcttaatgctctcaaagcaatctttgtcatttcctttgaatagcactttgcgagtttcacttgacatatggcatggccctcagggatataggcatttgcttttcagtctaaacaaaaatcaagtttataatttttatttttgtaacaatttatgtcagtattcatcacagaaaagcatattcctctttttccttctgacttacattcctcctcaagctacctgtaagtaatgatcttgaacagtacacaactgacaagtgtttcctgcgtcgaagaatggttgagtgtgtgagtgtagaacaatagaattatagtttataaatactgggatttcaggactaatgtaataaggagaaaccatccttcctttttatagctttgagggaattgcaggaacaactactgcagcttacagtagaacataactgtttagaatgccttttaacaattagtatttagtgtctcactttatttctaaggccactgcacgtgatacagaagcctgatgacagtagcatccacattcttttaaaaatgtgtaaaataaggttataaatgtttacttttacaaaaattcattgattccctcctttattcaataaaatgtatcaagcacatactacatgataggctctgtattaggtacccatgtgcaaaatagacgtttcctgcccttgagaagcgtacagcttagttgagaaatttactagtcacataaaaccacaaataaatgtataaggtaagctgtgatactgctattatgaagaggcacaggatgctgtaagaacacataaataggggtttcaatgaaggcttgcttaaggtgttaatattagaattgagctgtaaaggatgaaaatgaattgcttagatgaaagaggtgacaccagagggagcgggcagggaaagggggagagtgttccaggaatgcagagagacagtgggaagaaatgaggtcatttaagtggccaagccaggtcaagctgggcttgttagtcactaacatattttgttttttatcctcagactataaagtatggaatgaaataatcgtatttgtgtacttaaaaatcactctggatgctatgaaaatataatgacattgagtactgctttcaataagtcacagtggaatcttgcaaatatttaaaataagtcaaccaccaaaacaagaattgtatttgagttaacagcatgtccacagaagggtttaattggattagagctttgaaaactgtaagtagaaacacaaattgcttcagagaatttataatcctggaatgatatttcccatgcccagagagaaacccattcctcttgttactgtcttcagaaccacagagcatgtcattaaatagcagcttagatggctgtgcaggcctactagggtgcagatggattggataggggtcaggttgcattggagtttcttagaagcttcacttcacctaacgttggcaaaacagctggacctcagagaactgcatgcacgaggtaccagatacacgaaaagaggcaaagcgtgacacagtgaaataacaggtactgatgttgagacttgtgaggtggcgcctggtttctagaccaggaagttttcttactcatctcttcttacaatgggtgaggcaccgggcacacatgagcgtatttaactttccaacagccatgtgaggtatagagtgtcagctcctttttaataagtgagaaaaatgaggtttagagaatttaaatactaatacccaaagtcatacggggcatgaggacaagattcagactcatgtctgccagctccaaaccaggatttatctgagcttatgtcactcatttaaaattggtatttgaattcgtatttatttttgaaggtgttcatacaaagaaaacaaaaagaaacggagtctggattgtagaaaacatataaaacctatatcaaaaatcatctaatagtgatagatagagaagtttcatattgaaataagcttttagaaaactgctctggtaaattaattggtacaaactaagaataaaaatgggatggttagcatagcttgtttgtcacaagaaacagaaacttcacctgcctttttccctgtgaagtgttggtgcagtgacaggattcgcctctcttattaatagtctgtcaaaatccaggaaaatcatgtgatgcttcagagatttttctactgagtgaatatatttgattaaacaccatctgcaaaaatcctcatcacccaagaaaataacagatcgtagatctaacacatgctttacatgtgtcaagaaatatgttggtcaaatcaagagataagcacataggtttatctgaagtccaacttaaaacagctgctttcaaattccttgctaagccaggaagcttgactgatgggacccagagtgatctccctgtctcccctcctagctgtttcttctcacctctgaagttactttttccacattgagggggcctttcatgagtaccagggagaatgagtcaattgagttcatgcaaaaaaagaatcccatcctttcaagaaaggagggagaaaagaggagggaaagaagatatttaaggggttttgctattttatctggcttaagttaaacttgtaatgtcaaaaaataaagtctgaggaaaatatgagtaaattttatctttccttgaggtggatcctttttagtcattggagcaaagtcaaaaactgtaacagaaaatattgataaatttaatataaaaatgttaaatgttattgtgtcagatgaagataaatacaattaaatttaagtgacaaactggaaaaataataatgacattaattacagaataagtatattaggtaaataaaagctcatagtttagtaagaaaaagataaatgataggaaaaaaacgaacaaaggatatgactaggcaggtcacaaaagaagaaataaaaactaccaagaaacatttaaaaacatttcaatcttgttggtgttcaaagccacacagatgaaaacaatatttttgcctatcaaattaatatatttttacaatgtaacccccattgtttatgtaatgaaaaaggcacaactttccttattggcaagttggcaatatgtcacaagtcagtataatgtctaaacttatccagtaatttacctttgtaaaattgttcaaaagaatacttggacatgtatgcagttatttgtgctacataattatttataatggtgaaatatctttaataaatgtaatgtccaccaatagaggattggctacttaatttatgtactctgccccgatagtaccctgtaaactcagtttttaagtctccacaaatttatgttaatttttatcattcattgattcaataactaaatatccattaagtgcctactgagtgtgttgggtacccatgaagacacaggtgatccagcagtgggcaaacagaggaaaattcttgtcatactagagaaccaaatgattcaatgacaatgagtaaagcatgttttgcatcagatggtgaggagtgccattgagaaatgctgagcaaggatggggataatgctagagttaggtggaggaagggacagtgtgattttaaatagggtgttagggaaggcttagtgataaagtgacaagtgattcaaaactcgcctgatatgaggaacagaaacctgctgatatcagagagaagggcatcccaggcagaggaagggcgcaatggaagccttgaggggagagcatgctggatgtgtttgaataacagcagaagggacactgttgctgagcaaagagaaccaatggcagaatagcaggagaagaggttgcagagaatgaagagaaccccataggccattgtgaggatgcgggctttttactcagaaagggatgggaagctgttggagggcttggttgatgaagtgacattattttacttacatttcaacatcatcactctggacactgtgtcaagaattggctgaagggacgctgtggagccaaggagaccatttaagaagctattgtaataatgaaggaaaaagatgttgggaatgtgagctgttgtagtaagggtggagatagtagggaagggtttggttgatatacttgaaaattttatattgtttgaatgtcttaattttatttttaataagcaatatgtttacatgattcaaaagtcaaaattattttaaaagtgcatacacacagtccagtccttctgaatcccattttattaattacctatttgttcttccaatggttctttatatgtatatgtctactcctgtagggtgtgtgtatgtgtgtgtgaataaaggaaggcatcaaatggattatgctagcttttgtctccctttcttacccaaacatgtttgcatatgatataaaactgcacagtacttacttttctcacctaaaaatgtatgattatattttgaatatagagccaacaggactttctgaaagattgcattaaaggtattaagaaggagaaacatgaagtgtgattttaagtcaccggaagaagcgtgttgcctttgggataattgcttgttcagcatctttcttccctgacttaacgggagagaccatagctagatggttcccatctacttcagtaaccagtaaatgttagaagccgcatatttactgttgaataatgagtgattgataggataaatattgtatacataaactaaaagagaattcaagtagcaggataaaatttgttttcatatatatttaatgttttgagaaagtgcttctaggactttggtgaaataaatatttgctctgcttatagaacgtgctgcagatacacagagagtatgttggtatctatactttaaaaatttgctgaaagtacatacacaagaattttaatagtagttatctcttggggttgggattatagatgactttttttttgcttcattattttatgtcttttctgatttatttattataaacacattttttatatttttattttattattattattttttaagagacagggtcttgctccatggcccaagctggagtgcagtggcacaattatggctcactgcagcctccaactcctgggctcaagtgagccttcctcctcagccttctgagtagctgggactacaggcgcacaccactgtgaccagtgaccagttaattttttaattgttttgtagggataggatctcactatgtttcccaggctggtcttgaactcctggtctcaagagatacactcactttgtcctcccaaagtgttggggttacaggcatgagccaccacactgggcctctactgtagacacatctttataaaattaggaagaagtgaaaaaaaaaaataagggatgtgatcccttatgtgaaattttgtttttcctaagttgaaaaatgatagaacaatgtgtaatgtgtacaagtgacaacaaaataaaggagagtttcactacttcttaagataaaccctggagcagactacctgaaaatattaggaaattttcactttagagatgcgtgagatcgggcagccagaaaatgacacagcaaggaaggactcctgtcatttgatgacactcatagtctgtcagggcattaatcagggtatagaaatataacatctgtcacaaattctgtgagatgttcttgctgatttcttctatatacagtgttattttgacattctgtatataaaatatggcactttttatccatgatcagattttcaaaatgatatctgtgccagtgacctacatttttgtctcacttgacaatgacttggggctctttccctattagatcatatagggaatgtctacctcattctcttttttgccattttcatggtacgatttatattatataatagggatgtgctataatttatctggtgtcttccatattggtagacaaatatatttgtcctcattttttactattacttagaacgctgtaattaatgccgcaaatattgctcaaatgtaatttctttacgatagtttcctagtattggaattgttgaattaaatagtatatgtacttgaaatttattcattacttcattcaaacatgcaacaaattttatgaaacatttactcctacgtcagacatggttttagaattagagatttagtcatgaacaaattaaaccgaattcctgtacttttgcagcttaaataccagtggcaaaaccagacaatcaataagtaaacgagtatatttttgtgagtatgtgtgtatataaaatatgaaaagagagatacagcagcatagcatcaaatagtgatgagttctctgaaaaaaaaaaacagcagggtttgggaatgaaggacaacgtggctgctgtcagttagggtgctcagagatggccaatgtgaaaagatttgacagaggtctggatataatgaaagaatctgaatttctggggtggggtgttccacgtgaggttctaaggcagaatcatccttgctgtgctcagggatgagtatctggagtgcaatgggcagtggaagaggattggggatcccagtggagatgtagtcaaaggctggtaggaaataccagtggagaggaaggtgggatagtagaaacgttggattttactctaagaatgatcagaactcattggattgttttgagccgaaatgtgacatgatctcatttgtatttaaaatataattttggttgcttttttgaaaaaatagactataacacagcagtattggaagcagaaatctcattggagaggctaccatagcaggctagacaaaagataagagtgccttggagtaattgttctaaacactttgggaggcccaggtgggaggaactcttgaagccaggagtttgagaccagcctgaggtacatagcaagactctctctctacaaacaaagttttaaaaaaagattagctgggcatagtagtgtgtgcctgtagtcttagctacttaggaggcggaagcaagaggatctcttgagcccaggaattggaggctgcagtgagctgcaatcctgtcattgtacttcagcctgggagacagagctagaccctgtcccctcccacaccaaaaactaaaaatcatttaaaatgttcataaattcagccacattgtcctccaatatgactttatcaaacctgtcttttgccagcagtatatgaaattctccttcccaaatcctcaaaagcagtgggtctccatcactttttttgtgctcggcatcatacttggcgtagagttggcctttgatcattatctgttgaatcgatgaatgaatttaagtgtcactattttgatgcttagcgatataaacttgttttgatttgcatggtttgaacttcaagatcttttcttacactgcttagaaacttgtttttcttcatgaaatacctgttcatgacatttatttattttgctcttagattttcttatgtatatgttggacttcttgatgttttccaggtattataactttgttatgtgttgtgtatgtggcagtatgtggtttttgtagactttatttttgtgtctttgatagtaccaagttgtagattttgatggatacattttatacatttttggttttgtgatcattttgggaaagttagcagtctttcatatccaatattttattctcactatttggttatatacagatagaaaaatgaagatttagcatgtttaagaaatttaaggacaaacaagttctgtgaatctcatggtcagccctttctccaaagggttgatttttcaggtgtgcttcatcatgtaatatgaaaaaacagaaagtagtgtgactggggagaatggaaggatagtatatgaagcatgattacaattttatttaatattaaaaactaccttatagctagatgtatggatgattttttattttccttatacgttctgtaatttccattttttcgaagtgtatgctgtgtgtgtgagagtgtgtgtctgtgtgtgtaatgagacattaaagtggccctagtccagcaggaaatgacatgtctggggcaacagggtagcaaaacttcagataaggaaatctgaaatgaacagatgcccaggcttgaacagagagtagaattaagtggtttttcattggaattatggagggagaatgaaatttctgaaaatcataatggaatgggaggaaaaaaagtaaacatagttaaaaaaaaaaacgatcatttaaagaagactaggaaatgagtaaaaagactgagggaggaaggggaattctaagtgaaacgataggggtccatatcacattgcatcctgttaaagctgtgtcaaaagtgtatgtttcttggccaatggagtactggatatggaagacatcttctagttagggcagcaatacatgacagacatcgataatcagtcagagccctccttcacttctttgctaagtcttcacagtgcaggtcttaagtaaaatgtgtcagggttgatgctcaaacataaactgtgtcccgcgtaactgtagttgcacgccctcattgtgaatataagtaagacagagaaagatcttgtcctcagtcgtccagctctgattatatctacctttaccaagtacatttcactatgattattttggtgctcattatccatttgatttctccttggatgattactttgtggagcaacagaaagagcatttgtaggatgactcaggaataaacctgttgatatagtttggttgcttgtttccgtcaaatctcatgttgaaatgtttccccaatgttggaggtgggcctaatgggaggtgtttgtatcaggggggtgggtggattccccatgaatggcttggtgccatacccatggtatgagtgagttctagctctggcagttcacaggagagctccttgtttaaaggtgtctggcacctcctcttctctctctcttgctccctctgttcccatgtgacatgccagctccccctttaccttctgccataagtggaaacttcctgaggctctcatgagaagcagacgctgacactgtgcttctcatatagcctgcagaaccgtcagtcaagcaaacctcttttcttaataaattatccagtctcaggtattcctctatagcaaggcaaattaaccagtatacctgcattgagttgcctccaggatgactggcctatgtgtccttgattgcttcatctgtaaaaaggcatgttgatactggacttactgggtagataaatccccattgttttttgatctatgcttctatgattcttatgagactgcaaccctagaataaaattttggcaaaatgatagcaaataacacagccatttataatggaaaactagagaaatttccatttaataagtcaaaatatgattttagagccagcatgaacacacatcagccatttttcacttctgtaataatattaatgtctacatttatttgctgtatagaaaatagtgctcattgcacattagttttttgagattcaggaaaaacaaatcatcagcactctttgacacttaatccatctcaatgtcattatatctttgaattaagttattaattacccttaattaaattcattttaaatggtggtgctttcattcctaagtgcttattttgtaattcctggaaaagtcataaattccactcagtttaacaaatattaaaatcatttcatgcaaggtatagttctagatattttaggtaaccactaatttcatatcccttggggtaaaaaaataaacatgcttccatctcttgtaactataacttctgttagagctttgctcttggcttatactttctggaagaagtaggggttggcacaggaatgggagaggaaatgatctcaatgattaaaagaaggatttgaccaattcctaagggcaagcaaacatcttgaagtttaaagaaatctcatacacgtctttctatagggagcattagatgatggataatgggctgtgttgccaacataacttttacattagatggtgtaattaatttttcatgattttgtttattgagactatgtatttagaatgaaattatatcagaaataacctagtgcaaggaattattcaaggccaaacttaagttctaatatgtttggtatctagcggcctccaggcatagcaggtatacagctaagaggcatggagcaatttcagtttctttaggcggcttttctctcaattatttctcttactttgtctttgagagacgcaagcaatctccagttgggcccttgggacaaggcatggtggccaatatgctaaatggcagctgatccatacactgtttctttctctctgtctctgtctctctaaatacaaaaaaaaagttgaaaattaaaaaaaaattttttttaattattctatttacctactcttgttatgtaagtgtggtatgtgtattacctattggcttcacttttaggtcatggaggacaatgatctacatcctaataggtggttttccagttttcctcagagtaggaaagattgtctaggaaaaatgaaaaataggagatgaaggtgaatgctaactcactgctctttgtggagagtgctctacacattatcattattattgttatttttcgagacagaatcttgctctgtcacccaggctggagtgcagtggcacgatctcggctcactgcaagctccgcctcccgcgttcatgccattctcctgcctcagcctcccgagtagctgggactacaggcacccgccaccacacccggctaattttttgtgtttttagtagagacagggtttcaccgtgttagccaggatggtctcgatctcatgacctcgtgatccgaccgccttggcctcccaaagtgctgggattacaggtatacaccttatttaaagccacaggagatgagaaagaagtgatggtctattcccaaaaccttaacaattatttctcctgaaggcataatgcatctttaagtgctaatattttttaaactgcgatagaagtatttcatgatgcgaaacaaatgctgtctaatggtgtggggctcataagtattttgcagaaattaagttgcacagaacatcccaggcatttcctgtagtagccacaaacaggtgattaggttgcctggggaaaggacatagcaaaggctttggttggtgacttccttgagttgcctggattttgcaaacagtggtgcactcatcaaatttttactgcagatgtgtgtatatgtgtgtttgtgtatatgtgttgataaaacgtgttgtattaattaatgaattctttatgaataatagactttatttttattttttatttttttttttgagatggagttccactctttcgcgatctcggctcactgcaacctccgcctcccgggttcaagtgattcttctgcctcagcctcccgaatagctgggattacaggtgcctgccacaacgcccagctaatttttctatttttagtagaggtggagtttcaccaggttggccaggctggtctcgaactccaggtgatccacccgcctcagcctcccaaagtgctgggattacaggcatgagccactgtgcctggcctagactttatatttaagagcagttttaggttcacagcaaaattgaaaggaaggtacagagatttcccatatacctactgcccccacacatgcaccaccttccacattatcaatatcctccaccaaagggatacatttgttattattattacccagaatccatagttgacattagggttcactctagattttgtatattctgtgggttttaacaaatatgtaacgacatgcacccaccaatacagaatagtttcattgccgtaaaaattctctgtgctctgtctattcatccctctccacccccaaacccctggcaatcactggtctttttactgtctccatgcatttgccttttctaggaagtcagagttggatttctacagtacctagagttttaaaattggcttctttcacttagcaatatgcatttaaatttccttcatatcttttcatggcttgatagaatgctgaataatattctgttgcctggatgtaccaccagatataggtatcctatatctggattccgactgaaggacatcttggttgcttccaagttttgggaactatgaataaagatttatttggttatgaatcaagctgctataaataaagaaatcaagctgtgttttatgtttcaatttcaaaaaatctaacaatttcatagaaaaatctgcatgcctttttctttggagaaatcacaaaagaacagtcagtaccgggaggtctgcaaggcaatccacagaggctgttgaagaatggcatggactttgcgtgggcctgagttctgcattcacagtggctcccatcccagtccccatcctcatacatcctgctcacacacacttgactcttcatgacacctccttatactataagcatttgagtttgcatctcctagggagatgggaactaattggttaattgttattttaagggttttgccttgccttcaacaaccctgggttcttggtgcatagtttgccctttatctcttcagttaatgttgctaagtcaagatttttatttggctggggggacggaaaggaatgagggtatgaatctatattattatagatagattgcattatatgaccccatatatgaccccagcatcttagaccctccttctgccaccttcccatgtggcagagccaagacccttctgcagctggtcctcacttctctttttccctcttgccacatgctcctacagcctggtgatccctgtcccatctcttgccaaatgttttgctctgagctaagtgagtaactaagtttcaaaggaagctaccatatttaatacagtgcatgaggaagaccaatttctgatttttgcttagccacagttttctttttcttttttttgttttaacctttaaaaaaaatgtggtaaaatatatataacatttatcatttaaccattcaaaagtatggtttaaccattcacgagaggcattagatacattcacaatactgtgcaaacatcaccactatctatacccaaaactttttcatcatcaacaaaatctctatccattaaacaataagtccctcttctttcttccttccctccccaacatccccagccttggtaacctgtattctactttctgtctctatgaattaggatgctttgagtgttctgggatctggtcctcactgtcagctaaactctccaagtaatcgtcactgcaatattatttttgttttgttttgtttttctggagttctgagagtgaggaatccattatcaatgacctatagcatgaacatttttgtgggggaatgtgtgtaaaggtatatagacatgaatatttgatgatctgacatcccacggtttaaacctagatggggcttctgtaaatatgaactcaaggctttaggagcctcccaagatctgacattccaagagtagagaagaatggagagacacccatgatggaattatctgttgcagacaagaacacaaagatagctttcttcatttagaactaactttgaggactttacatagacagaaatgttctgtctccttttttttttccagttacagggaatgttttccacttgtggtccctaaaaatgcagaaatatcatagggagtgaaagttaccttgtttctttaactgccgcaatctggcctcactcaacatgtagcaaatgccagaatgatagatgatagattatagtgatgtcgccctaggttaacagtctttctaggtaaggtacttctatatctgaattgaaaagtagggcagctattgcctcagatttgggattttaattacattgtttccacgtatgatattctttctaagaatgtctctagcacttagtctctgctttatacaatctaccagttaattatgtatttatgatgtaagtaatttggaggcacagagaaaggcagtggggccatttctccgcatggtcttggtctgggtgcatgtgccacatgattcacattatttacataaggaatggctttactgatttgaactggctgagtttgcttgcttttaaaactgcaacaagccaggtgctgtgccatgcacctatagtcccaaatgctagagaggctgaggtaggaggatggcttgagtccaggcgttttgagtctagcctgggcgacatagcttgagcccatatctaaaaccaaaaataagtgataataaataaataaattcaatttagatttggtttccaaggtacaactgtcaaacatctttttaaatgcaaatatttcatgtttcattttaacctaaggttgtgtcatccatttaaaatactttacagaaattggcctaactgcttatgtgtactgcttgatttgctttcctctttgttgttgtaagaaaaatgtcccactcactagtctggattactctgttgcaaaattaagggatctgaaacatctcaagctttaaaaatgtttgagcatagcttctcactaaaataatgagccctgtgtatctattgcaccgtaatctctaatatttaaaatgataaaggacttctagttcaaacccattattttcaattgagaaaattaaagtccactgaggtgtagtcaattgccagctagtgagtcaaggaagtgttaaggttatcgtcttatgctagatagagcctgggaaaggaggtgggtcttggaaatttgcggttcataacagggttgtctgtggggctggcagaaaggtagaatatgactctgtggatagagatcagggaaaaaataaagactgcagatttggggctgtatccatgtataggaaacatgagcctgacaaaaaatagagatgcagaatgagggaaggtgtggtcacttctgtaaaaatctttcaaacactgatttttgaacaattcattgctcttctgcagttgaaagaatcccaaaggaatgacacctgaatggaaaacctccaaagatcccttctggttggaggccctgggtctccaattgacccttcaaatatattattctgttcttttgtgcatttctctttttattgcaaagaaagaaaattaaaactatcatgaatgtatttaaaaattttattagtctgaacatgaccactttattgattactttattgattatgacattctttttttttttcagacggggtcttgctttgtcaccaggctagggtgcagtggtacaatcatagctcacactgtctctcaaattcctggactcaagcgatcctccctccatagcctcccaaagtactgggattacgagtgtgagccaccatacctggctgattatgaaactcttaaataccactcacacacatgacttaaggctatttttgatgatgtacagtagcactgtatccattcctggacaccagtctttgaagagtgtttggctctgtcccatatatacctattgatacaatgttttgagtgtttatttatgatataaatatatttatatttttataagtaatatacataattgctataatattaagtatcatgtacattatagggaggagtctcagaagtaatttaaggaagatgtatttgtttgtctccagcctgagtggtgcaactacatgagcttacagcattccttgaattacagatggctcatacctggggatacagattagcctttcctcctgtgaactgaaggcttccatttgtctaggtactgggtagagataattttagtgtctctttgaggaatattatctttagcaaacttgttttctctcttacaacctctcctttacaccatttgttaatttttttttttttttttttgagacagagtttcgctcttgtccaggctggagtccaatggtgcgatctcggcccaccacaacctccacctcctaggttcgagtgattctcctccctcagcctcccgagtagctgggattacaggcatgcgccaccatgcccggctaatgtttttttttgttttttttgttttttgcatttttaatagagatggggtttcgctgtgttggtcaggctggtctcaaactcccgacctcaggtgatccacctgccttggcctcccaaagtgctgggattacaggcctcagccactgtgcctggaccatttgttaatttaaaatgacacatttatggctgggtgtggtggctcactcctgtaatcacagcacttcgggaggctgaggcgggcggattatctgaggttgggagttcgagaccagcctggccaacatggcgaaatcccatctctactaaaaatacaaaaattagctgggtgtggtggcgtgtgcctgtagtcccagctactcaggaggctgaggcaggagaattgcttgaacctgggaggcagaggttgcagtgagccgagattgcgccactgcactccatccagggtgacagagccagactcagtctcaaaaacaaaaaagacacatttataatactagtaagggcacattcaatatttaaaaagaatctcatacagttttcatttttgcatattacttttcagtatattcattagagtcctaaaatttatactatcttgtattgtactcttttgacttcagaatgtcatcaaaaaatttgcttctgttaacaatataatcctactttcaattgctttttaataatcttgggtactttgagactgtaatttagctagtctccaaatttgggacatatatgagatttttttttttttttgccatcatagagaactctacatgaatcaggtttctgtctttatccttcatgcttctgttgcactatttccttggtgtgacatgccgtagtcaagaagtagaagcatgtattcttgtcattataatttcctatttttctgtgaacattttgaaatactgggttggtgtagctcttagctgtcactgtcaaatcacccccagtgtgagcccacacgttcaagattatttctctttttctcatttcaactctgagttagttccaggatatggttgtatctctgcaagattgtcagctccactgagtgcctccactcacatagatgagtggggtccctgcccagtgcttcaggtagcagttcttctctacacaatcaatgatgttaccactgcatgaagctccctgaaagtgtgcgtatggagtagtcctcgcacacaggctgaaagacatatctagctatgttgggcaactagtcccctcagaaaatgattgcctcaggaacaaatatttaagttgaattgttaagtgtggctgctaccatcgtcaatggaagagaaccaaagcactcgctattacaaaggggcctctagtggccaaaactctcagctctgaacgttgttcctttgtcctcctctctacatcctcctgagagaatggtacttcaagatttcatagggcaaatctccaacttccttttggaaaatacatgctttaccaggacgcatcatctgtccacgtgaggaacaatggaggagaccataatactctaaatctggaatatgtcagttgacctgaatgccatggggagattcagctgaccatataggataagcagggtgttgtggtctcttttgtgttgctataatagaatttctgagactgagtaattcataaagaacagatttatttatattgttctgggggctgagaaatccaaggtcaaggggctcacatctggtgagggccttcgtgtgagggcatcaccccatggtggaaggacagagggcaagcaaccatgcatgagagagagaagaaaagggggacagactcacacttttattaggaacccccttctttgaaaaccagcctactcccatggtcaagacattaacccattcacctcttttttttttctttttgagatggagtttcattcttgttgcccaggctggagtgcaatggtgcagtcttggctcactgcaaccttcgccttctgggttcaagcaattctcctacctcagcctcccaagtaaccaggattacaggtgcctgccatcaggcccggctaatttttttgtatttttagtagaggctgggtttcaccatgttggccaggctagtctcgaactctgacctcaggtgatctgcccgcctaagcctcccaaaatactgggcttacaggcatgagccaccgctcctgaccatcccatttacctcttaggggtcccacctcttagcactgttgcactggggattaaatattcaacaaatgaccttttaaaaggacacgttcaaaccacagcacaatggcactacaagttagtttccatttacaaatgagcactgaaaccaataagatttgggtaactgatatggaatcacaaaaaaaaatctaacctgaagcaattttacagtaagttggttatactgtcaactagtgtgacagtaatagaattggagtctcaggagaaagaatatctacaatgagttcatctctaggtattttgagcttttctttttgaacttcctctacgagagttttaaagtaagttatccatattttacagaaaacttcaaggattctagctggaaggagaagaaattatcaagtttctaaatatcagatcttactttattcactatttgaagtgatggaaatcagattgcagttcaatttttttttttaaagactgtactcctctcctctgccaaagctcatgcaaagccaggaaaacaaatattgatttttattttctctcatctctttcagtccaacctggttttcagtagtattgaaatcagatgtacttcatattgatctgggtcttgaaccagtataatccctgattaacacaattgaaataaccatcatcaaggtggttctaaagatagagaggaaacagtgtggacgcaatacatttctgctgtttgctgtggcttcctggttctgtgaattatgcattggatcttgggcaggaaaaaatacagccagatcctgccatcattttatgaaattagggtgagatatttggaagtagcacgcccatcaccaacactgtcaaatcattagtccatctgaatgtctggtaaatttaggtagaaatatttggtgttatcattgccttccaatctcgtctatctcaaatgctgtatcaatgttgactctgacaatagtaagggaaggctggacaatctggaaggatgggtaaggcttagcacaggtgaacagctgtatatataaccagaaaggcagggctatcaatttgagtcctctgtctataagagagggtgaactttacaagataaatatgccttatcctcagctgagcacagaagacccattaaagcaaaaaggtaactcaggcaataatcatcatggcttggtaaaaagcagttctgatagacttaatctttaaggcagaaggaggacaggctggtggttttatgagaaagtaatgaatccttttgacaattgtattaagactttatggacataagacctaagtcagagttttaaaaatggttctcagagacactgttttggctttgttcttagtcacatcccttcattcaggttagctatctgcctgccctgcaaagcccgcctcttttgtgaagcttttcctgaccacaccagtatctgctgatttatcatcttctctaatctctgaactaactgttcagagggatgaacacagtaaatactaatacatgccgtatacactccaccctctcccggcctctcaagttgtttgtaaactctattttatagttacagtccacccaacagtacaggtggactcagcaccatgtgtgtttaatttgttgccccactttgccagatccatacaacatcaatggtatcatatttatcattgcactgcccattgtctgtagtattctgcagtgcacatagtacaaaacattacagctgaattttaaagaatgatttaacattcaccagggaaattatgaaatacaatccatatgaaatatgtaatccttagcattaggacagcttctttctaaaccctgacttgtcctcacctctcaaaggtcatgtgtaatcctagccactctcaaatgtttttgtccactccaggtctcagcctattagcacatcctagttccctggccatgttgattggttcagaactagttacagtatccaattaaaaacaatgagatttttttcttgaggtatctgagaaaaagatgttcacatttcccggctggatccgaaacctcagagtaggtagggtctggagagcctgtcctcaacttgctcttccccaatgcctgggatgaaacagagtaaagtgaaggagagaaactgattcatgatgattacatggtgcattctacttccctgtaggatgtagagaaagacgattccctactttcctacttctcaagttatatgggtcaattgatttctttttcttttacatctttttcttttctccttcctttcttccttcttaatttcctgccttcaaagcttctttcatttctttttttatttaacttaagcctacttggactgtgatttctctcacttttcactaagagtactactcaatacccaacttgagttgatcctgtttctctttggtacaagagtacaattgtagtttattcatatgttcatagttggacaaattaatgtgtctacagcccaacggcaaactattgatataaatgcagtatctcctgtttttctaaatggtgtccagatttgtagagatacatttgtctatgttgtgagaattgaaagcctttcatgcataacttgaatgctctgtttatgtaagtaatttggcatttcttttcatgtgcaaagggttcctttgattttgaatgcacaggctgtgacactaagcagagaagatgagaatcagaccggggaagaataaatttcctttgtatatgactatacaaagttttaaaactttatctccctcagctcggtatttaatagacattgaagacaggaagtagggagctgtgactggctgtactcgacttttccccaatacagttattcaatttctatatatgctaccctgacaggcttatttcaattttagtcataaacaaaatttacgttttgacttgaagtgggtcaaaatcagtgtcagcattttgttttgtaatatgcccttcacatcgttgtacctttgccataatcagccagagtcagagaaaattatcatccctccctagtgggtgctcaacttaaaaaccagcagagaagatttttttttttgtaaagaatcaacaaagtatgaaaatgaaatgtcaaatgatgaaaattatatgattcaggtttgggatgctggatctttattttcagggacttatttcaaatccaggtacaagtctacagttagttttaggaattttagtgagcaatgggcaaataagttaatgctagtaaaagattgccatattactgcattttgttattgaaatgctaatttataagtagcaaattagcatttaaaaagacacaatttttgttaaaatagtggcctttcttacattttgtattagagctttactttttttctgctttaagcttcacaatgcagtggcagcttgtttcacttgagcgttcttattgattataactgctggtatgaggcaatctgtgcttcccttgtgttctgcctaacagaggttatttctttgcatgatatggagatggatatggaagaatctgggctgtcagggaaggaagtgagagccagagaggagaaagcagccagggggtggagtggtgagcctaattcccagctcttagacaatgagatagctaggagcaaacctctgttcattcttgcctgacagttgtcatggcaactctcaatccagtgacctcttttagttctctaataaacgagttgaatatttgttaagtttttggtttgtttgtttttagtatctaattctctttgagatgatcaagctgcaaactgattccataccttattgattcagactttgtaaaaagatattatgcaaagttgaagatgtgtagatttaaacatttcaatctttcttttaagagaattttctccacaataggaaggcatgtgggcattttatggtcttagccaacataagcattacacttatgaaattggtctagccttctaggctcctgccccagtgaggtccctcctcagttctgtgatcataggcaagtcagttccctgccccagctctttgccctcttccatggcatggtggggttgaaattgacagagtcacatttcccttctgactttaaagctttctgactctgaatacataatatataagtgggtttctctttttgacattacatactgtagtgaagtacagtcctgtaacaggcatctgcagactacagacgcacgttaccatgcagattgctattaatgtacagttctctccatttaatttgctgtggtttccaagactactatattttttattgagaatactaatagcctgtgtgaggtatgaaatgaatacatagtttcaataggactgggttagtgactgttggagaaaatatcttgaattagagtacactgttttattgtttatagctatcagaaagttctcctgtgaggacaataatataatgatctctatcctactatgtgctacactttatttaattggttgagatgaacatatgttgattaagaataaatttttaaaattttactaaatttgagaaaagcaacaaagtatgaggaaaacatatatgccaacaactgaaaataaaaagcaggtgattccattgttttttaatgaagcaccagtcatttccgttgggattagaatccattgtgctaggaaagtatttacagcatgatgctgccatatttgaataaagaagggacgagtggattgcctaaatggggttgaaaccatgtcaggagcacattacaacataaaccagaactcagctgagtatccaataatgttaatgggggcaaaacaagacttattaccatttgaactctatatctgaaatgggaatccgataacatggcagaaataacgtttggtttgggactaaaaacatcctagagtgtatctaagggcttaagtattcatgaattttgtttgtacacttacattatgtgttgtgttagaaaaggcagaaaaaggtagtgcttcatgtttggttgcaaagactcctgcctcagccttgttacacaggagcataacggtgcagtgtgaagcatttaagacaaaaacgttttagagtcagatctgagtaaaatctgagatttcacacttccagcagtgtaacctaagactagtttgttttttttttaatttctcctgaggcaaaattttatttttttctctttcttccatttcattgtaaccttttaaaaattgtgataagatatacataatatttttcagtgcaaccattcaaacatgtggcttatccattgatcggtagtcttagatacattcacaatgtcgcgtaactattatcactgtctatgtccccgattttcctatcatctccaaaaacaactttgtaaccatgaaagaataacttctccttctcctcctcctcatgccacctgcagccatggtaacctctattgtactttctgtctctatgaatttgcctgttttaggtagctcatgtaagtgtaatcatatatttgtccttcagtgtctggtgtatttcactaagcatggtttcaaggtccattcatgttctagcatttttcaagatttccttcctttttaaggctgaattggattccattgcatgcatataccacactttatctgttcatctgctaaatagttgatttggttgcctctgtcccttggctgttgtgaataatgctcccaagaccagctgtacaaacagatattcgagtctctgatttcaattttgtgtgtatatgccaaaaaattgaattgctgagtcatatggtaattctatttttagtgtttttgaggaactaccatgctgtttccacagcagctgcgccattcctgccaacaatgcataggtgttctaatttctccacgttctcaccgacacttgtgattttgtgtttttattttaaataataaccatcttaatggatgtgaaacagtaagttggatttgcactttcccagtagtcaattatgttgagtgtcccctcatgcacctattagtcatcaatatatcttacttggagaaatggtgtgaaagggtatacagttttcaaggttgaaacatgacaataattaggatgattggacaatttagtgaagaaaaaatattattactatagttaacatttttttggcacttattccgtgccaggctgttactaatgctataagtgcatgatctcaatcaacttttactatgaagttgaagactatgaaggtgcctttattatgatttctattgttcacttaaagacatggcatctcagggtcaacaagtatcttggcttatgttgcacagcttgtaagtggcagaaacctgatgcaaattagttctgcctgacttcaaagcatttggctgttaactgctatgccatgttgtctaatgcgtggcttgttgcctaatagcctgtcaatatatgttaaaaatccattatccccaccctcaactgaacccacacacacacacgcacacacacatgcacatgcacattcctcaactttcaagcaccattttcatcctagtataaaatgatacccacccaccccctacccaagattcccaatcttcagtcatctgtcatgtaatttcattcatgtgccttggagaggattccctaaatttatttccacaaagaagcatatcttaattaggtctgttgggagatcattctacatgggtctcttgtatttctgtttctatagcaggagaagcactatgaaatttgtttggattatatgttgaaggacatttgtagagcaaataaccttggagaaggagatactatgtctttcttccagtatattaaagacaaggtttccatttggggaaaaagtcagggcattttcttgcagcccagtgtaaaagatccaggttcttgaagattggaattcctcagctttgacacaaactactaaattgggcagcatctgcctggactgcttggtgctgttgctgccatggaacataaaggggtgagggaaactggtgcaaacatgaagtgcatattacttgtcttttttctttccatgtgcaatgaaggcccagaagtcttgggtcttctgccagcattcatgaaactgtggcagggtcacctgttagcttgcaagtgagataaagccttagactcattactcttcttgtcaaggtctaagatttattagtagccttccatgcacaccaggcagcatgctttacctatatcatttcattcatgcactctgagatatttactgttatcatcctcattattcagataaggacacaatgcctaaacaattaacttactaggctgtctgatacaatgtgttcctcataagtcaaatgtagatcccacagcaacttggtatatagcatctgataacttgaactaaacataccatttatctggctaatacacatgaaggtgtagactcatgtacgcaaacattttgtacccttctaccattgtgaatcttgcacctcaggtgccaatctctttaacttgggttatgagaaattgtagttaaagttggcagtaattaataattttgagcttattccagtttaattaaccatatatatgtaattactggggcattatgaaagacttctgacattgaggaaatagatatgaaagcagcatccatacgcacttgattctcacttgaattacactcattgctcatatgccaggtggggtgtctcacaacaacccacttcttgtatcaaataatgcatgtgttagaatccataaaacatgaatttctaatcatgtaggccacctcttcactggagaatcttctctctaagctttaggctttatatttcaatagaacattttaatacatatctagatgattaaatataagccttccatgacagtgtccaggtgggagaacctgtcaggggagataatttgggagtggagaaccaatatttttggcagccaccactgacataccctaacttgtcttgtcaactgtccttggtttgagacactgagtgtgtggaaattgctttaatgcctttgaaatgtccaaaacgccaaatattacttaaaatgtaaagcctcttcatagttaacaaagagacattaaccttctgctttgtaaactccatgtaaattacgacacaaatgtaaggtattattatactcacatttattgacaatgaaaccttttactaggtgcttttggttcatattgaaagagactttgagagccattaatggatattaaagaggtgtaatttaaatatgtctacataataaaagcatgaaattagaagtatattatctttttatgagatttgtatgtttgtgatggccttatattgaattgcagtcactaatcatcagagaaatgcaaattaaaaccatcatgagacactgtcttacagcatcagaatgactattattaaaaagtcaaaatataacagatgccgatgagcatgcgcaaaataggaacacttgtgcactgttgctggaaatgtaaattagcacaatctctatggtaaaaagtatgacgatttctcagagaactagaaatagatctaccttttgatctagcagttcccctgctgggtatctacccaaaggaaaagaaattgctatatcaaaaagaaacctgcatttgtatgtttatcacaataggaaaaggaaaagtacagaatcaatctaagtgtccatcaatggatggttggataaagaaaatgtgatgtgtgtatatatatctgtcacatttcatggcgagatatatatatcacatttcatggtgtatgtatatattcagccattaaaacagggtgaaatcatgtttcttgcagcaacatattaatagatgggactagaggtcattatcttaagtgaaacaactcagaaacagaaagtcaaatactgcatgttctcacatataagtggacctaaataatgtgtagaaatggacatacagtatggaataatagacactggagactcagaagggtgagagggagttgagggctgtgaaattacttaatggttacaatgcacattatttgggggatagttacactaaaagccctgacttgacccctatgcaatatattcatgtggcataactggacttgtgccccataaatttatacaattttttttaaatgaaaaacctggagctttcccttggctccttttcctggaagctttctcacatcctactgtgtgaaatttggatgcttttgggaacctgaagataaaggctatagctacaccttaaggatgcccaagctgtttctgtaaggagactgagcttgtgaggtttttaatagaaaaatgcgaactaacctagcagccctggacttcatgtttctgtacttttacatgggagaaaaataagctttctatcttgcttaagccaaaaaaaaaaaatgagagaagcattttatttgtaaagatggtgttggggagcttgactgcaatattctgttcacctaatcactaataaaataaatgcaggaaagctaaaagtccacatgagtatcactagcatcagctaaatcaagaaggctggggaggggcagaaaacaatgctatacatttcaacaattgctgatcagggaaacagagacaaggttgaggcatcaatcctattcctggcccgattgctcaagttcactaaagtctgagaattctcaccgatattcccaaatctgaagtgaagtgaaatcagtgatatcccaagctgacctgaactagctgctgggaaaggaccagtgaagtgggaaacaggaaccagaggctaattctctgtcaatgcatcaggttctccagggctaacaggaatagtgttaaaacttaactcactcttccctctctgggaatgagctaaatctcaatactaagcagagtgaatcctgcacagcaaattaaacaaattctcaaaaagggagcagagccaaggtatgccagccatgaatgaattgacagtaaactgagcacttcaacgtggggaatcttcaagaaatgttcagccttcaaaatgtagctggtaggggaaaacaaataagtctcatatgcaaataagtagaaagagagactcacagaaactgacctgcataatgtcatgaaagtgaaaatctggacagcattggcaagacgaaaaggaacagaatggaaactataatcgcaattcgagccagtaggtaggtgggcaggaacaaattgatggaacatagcatggaatctgtaagaaaatgtaacctaagacggaagaaaattttcgatactttatgctaaaaaatacatgaacatggctgggcacagtggctcatgcctgtaatcccagcactttgggaggctgaggtgggcagatcatgaggtcaagagattgagaccatctgcgccaacatggtgaaaccccatctctactaaaaatacaacaaattagctgggcatggtggcacatgcctgtagtcccagctacttcggaggctgaggcaggaggatcgcttgaacctgggaggtagaggttgcagtgagccgagattgcactcctgcactccagcctggtgacagagcgagagtctcaaaaaacgaacaaacaaaaaaaaaacaacaacaaccacaaaaaaaacatgaacatgagttaaactggagccccgtcactcaccaaaaagaacacaacaagaaaaagagatgaacaaagagagtgagaaacttgaacaaaaaatattgaagactaagataatacaatctcaaaatgactaagtaaaattgacaagcatatagaacaaatataactgaaaattgacttattgatatggaagacaggcatatataaccacagccaatgaacatacaagaaaaatataaagcaaagagagaaaagatgatagtttttcagagcttagaaagataagccaacataataatccattgcctatgagacagaaaagcctacacatgaaattgcaaaaggtattaaaatataatagaataagccctgatttatcccaagataatgcctagttagattattttctttgcacagatttaaaagaaaaaatttaaaatttacatacagtaaaattccctttttgaggtgcagttttctgagttttgacaaatgcatagagtaactaccaccacgattagatacagaacaatttccttatcccaaaatttcttttgtgttacccatttatagttaattcctctcttttttcaatctctggcaactgtgtcgctataattttgttacctgttcctataattttggctttttcagaatgtcatatgaatgaaaatgaacactcttgagtctgaattctttcacttagcataatgtatttgagaatcatcctttcatttattaatatgtcttcatatttttgctcagtgatattcaattgtatctttgtttcatcatttgtttatctattcccttattgaaagacgtttatgttattttcagtttccagatggttacacacacacacacacacacacacacactcccagatacatatatatatatctgtaatatatatatatatatatctgtaatatatatatctgtaatatatatatgtgatatgtatctgtaatatatatgttagatacagatatatgttatatatatctgtgatatatatatataggcacacccatatatataaagctcttatgcacattagcatatggcttttgggtgaacatacagtttgatttatcttaggtaaagacctaggagtggaattgctgggtcatatgatacatgcatgtttaacttcataagaaactgccatactattttgcattatcaccagcagtgagtgagagttcttgttgtgccacattcctgacagcatttggtagtatcagatgtttttgtttgttttttaaaaattgtagccattctaatacatgtgtagtagtatgttgtggttttaatttacatttgcctaatgaataatggtgttgaacatatgtttgtgattatttgccaccagtatatattctttgataaagtctctgtttgggtccacttttaatcgggtcatttgtttccttatcatttcattttgaaagtagttattgttaagtctgaaaccgagaaggatctgagaccttatcctattgtgagctaacaatgtagtctgccacatatatacacacacacacacacacacacacacacacacatcatatatatgtctcatatatagatgtctcatatatagatgcctcatgtctcatatatagatgtcatgtatgtatatgtcatatatatatataaagctcttatgcacattagcatactggcttttgggtgaacatacacagacatatagatgtcatctatatatatatgtcatatatagatgtcatatatatatgtcatttatatatatgtcatatatatagatatagatgtcatctatatatatgacatatatatagatgacatctatatgacatctgtatatgagaaatgaggctttctggagcagaaaagcaaacaacttattgctcttggcaaaaacagccagagcagcatcttagtgctgctccttgagcccccttggggtggtgtagtgagaatcacaggtctttctccacatacaatctgtgttagagggtacagtgtaggagaagacgatggatacactatctctagcttccaaggcattttctattcaaatagagcccctgctcaagaaacctgtactgtgcagaaatatgaaaatcttcaatgagaattttctcccagtaagcatatattctggatatggttcttttttgttgttgttagatatgtgatttgcaagtatttttcccaatttgtggtttgtcttatttatttatttagatagcatctttttttgtttttgtttttgaggcggagtcctgttctgtcatccaggctggagcgcagtggtgcgatctcggctcactgcaagctccacctcctgggttcacaccattctcctgcctcagcctcccgagtagctgggactgcaggtgcccgccaccatgcctggctaatttttttggtatttttagtagagatggggtttcaccgtgttagccaggatggtctcgatctcctgacctcgtgatctgcccgcattgacctcccaaagtgctgggattacaggcgtgagccaccacacctggcctaggtagcatcttgacagagcaaagattttaattttataaattatgatttcttttttctttcatggattatggttttgctgttctgtataaaaaaaactttgcctaacttactgtaggtcatgaagattttctcttttttctcaagttttataattgtacattttacacttacaactatcaaaaattttgagttaatatttttataaaacataaaatttggttaggattcacttttttgataactgattgttccaccaaaatttcttgaattgcctgtgtaggaaaaatcacttgaacatatatatgtgggtttctttctggagcctattcaattgcattgatccatttatcaacactttttccaattccacattgtcttaatatggtagcttttactatggtagcttttactaggtagtcttgaaaccaggtattgtgagtccacaaactttgctgtttgttttcaaagttgttttggctattctcattcccttgactttctgtcaaaattttagaataaacttgttggtatttacaataaactctactggtaccttgaggtattgtgtagactctattgatcaatttttaggaacattgatatcttattaatattgtctctaagctgggcactgtggctcacatctctaatatcaacactttgggagactgaagagggaggattgcttgagcccaggagtttgagatcagcatggcaagacttcctctctacaaaaatgtaaaacaaaaacaaaaacaaaaaaacaacttagctggtcccagtgccacatgcctatactcctagatgcttggaagtttgatgggggagggttgcttgagcccaggagttcaagtatgcagtgagctgtgattccatcatggtactccagttaggtgacagaacaataccctgtctctaatatatatatatatataatttaaaaaaacaagtaaaatattgtctcctgttctatgaagatggaatacctctttatttaattaggtcttctttaatttctgtcctcaatattttgtcacttccagaatttttgcacattttttatttgatacactagaattcaattttaatggaatagtaaatgttgcttatcttttatttccaatatttcattgaaaacatattgaaatatgacttttttggattctatggctttgctatattaccatattacttccaggagcttttttgtggatgcctttgaacttcctatgtagacaatggtgtcttctattaataggaacaatgttctttctatcttccaagtctttgtatatctccctcttcctttttttcagccttttattgcactggctgggatgtttattataatgttgaatacgatgatgtataatggactttcttcctttgttcttgaacttaggagaaatcattcagtctttcaactttaaatataacagtagtctaagcatttgttttcttttggtgtgagttgcatgatcaggttaaggaagttcccatctattttagtgttctgagatttaatctgtcaaatctgtcagttttttgtatatattttgatatggtcctgatttaacttagtctcttactatggtgattgattgattttaaaatattaagtcatctttgtgttaccaggataaactatacttggtaatatatttggtattaccatttatatatagtgctgtttttggttttctaatattttttgtgcatttttgtgtctgtgttcaacaggaatattggcctgtcattttcttttactaaaatgcctttgtccttttttattaggaagattttttttggcctcataaaattgagaagtgtcttagaagagaatatgtggaattgttatcatttgttctttaaattgttagaattctccagtgaaatgatcgaggtctggagttttatttgttggaaagtttttaacacacattagttctttagtagatatagaactcttcaggttatctgttcttgagtaagttttgctaatttgcctcactcaaggaattggcacatttcctctatagacacagacagatttgtattattctcttattatttttcttttaatgtccataaggtctcagtggtgttccttttgtattcttgatactgatatttgtgataactctctttgttttggtcaatctgtctagagtttcatcaactttattatttttcagttaaagcagcttttgatttaattgattttctcttttgcttttcagttttctatttcagtaatatcaacttattattgacaccattgatatgtttattatgtatttccttctgctttctttaggcctaaattgctcctcattttctagtttcttatgacagtagcttaggttatttattttagggctttcttattttctaatatgactcaatgctgtaaattttctgcaaatattaatttagctgtcccacatatcctgatagattttatttttatttatatttagatcaaaatactttatagttcattttggttgtcttacttaacccattaattatttagggatatgttagcttctaaatcattgtggaatcaccaatgatttttatgtaattgatttacagttcaactctgttatgctaagagatcatactttgtatgactttaattattttaaatttgctaagggttgtttaataagcaaggaaagggtctatcttggagaatatttcatggttacttgaaaatgtctattactgttggattattttctaaatgcatttacatcagtttggtcgatactgtggttcaagtctcccatattgttgctgattttctgtatgttgtatggattaatgagagagaagttttgaaatcttaaagaataatttgggacttttccatatctccttccagttctatcagtttttgtcttattttacagttctgtatatatgtgtgcgtatatatatatatatacgcacacatatatatgcacatataaatgtaatgtgtgtgtatatatgtgtgtatacatatatatatgtgtattcatatatatatatgtgtattcatatatatatatgtgtattcatatatatatatatatatatatatatatatatatgaatgtaatgtcttcttgggtaattgagccttttattcatcaagtaatggtcctcaatatccctaggaattttcctgttttatagtgaaatttgtctgatattgatatagccatcccatcattctttggtgtttatatagtttaactttctcctttattttacttttagcctgtccatgttattatatttaaagtgcatttcttgaagtcattgcatagtagggcctttttttaatgaaatctgacaatccattttgttatttgttgttgttagatcatttatatacagtaattattgacatggttttatttaggtttagcttttttattagttagattttttttccctccatttttgttccagtgttcccactttcctgctttttgggggcattatttgaatatttttatcatgatattttaattattggccttttgggatatatattttatattatacccacacaaataaatatacacacacagtatgtgtaggtgtttatatgatgttactctacataaatatacatttctaacttttcacagtctacttaaaagttaatacctttttttactgcaaacaaaatcgggatgccttccaactgtatagatttttaattttcccctttatcttactattgtaataaatattctatctatatacattgaaaactccaccatatattttaattttaactttcacactaatgcacattaaaatcagagaaaaagtctactatattattcgatatttaccattctgttgttctgccttcattttggaagtttgaggcttctcactaatattatttttctttcatctgaagtacttccgtcagcatttctttcagaacatatttattcttgaggaattatttcagactatcttcatctgagaatatctttattttatcttccttcttaaagaatatttttattgggcttagtattctgggctggtcttttcttcagcactttaagtatattgttttatgatcttcctgcctccatagtttctgatgaaaaattcagagtcatgattttttcattcctttatatgtaatgtgccatatttttgtggctcttttcagacatttggttatgaggtttctattctttgtatagaatctattctttgtatagaattggtagattcaaagtaattttgggttgagttctgaacatattgtgacattatggatctttcaaaaatcctctgaatgatattgcttgttttaaaagcaagcagtcaacttaggtttggactgtgagtgttgtctcaccttctgtgggtgattgatccaatgtcagttatgttttaaaacctttgttactctatatttgactgtcctaaaaatacatcactcttctgttattctggaacttaggtggtattttatatcatatttttactttcaaagcctttgacatgcttctttgggtctattacatgcgtgttctacttagcagtggctcagaaattttgttggtttatacacagaattaagcaattcttgtctctagctctctctgctccaagattcacctcaaagtctgcagctctcaagggcctcctccagttctgaggccagagagatgggttttttcctttggcttttacgtgcctgggctgccactaccattatcatcacaggagtgcattctgccaccgggaaagacaaggtgagaaaaaagaagagggaaaagaaacaaacaaacaaataaataagtagggattcccccatactctatggttcatgggggccctctttcccagcgatctactagaaagatttttctcgtgcctttttttttttttaatttttatacctgctgtatgtgttttaattagtccaccctcatgtcaaagttgggtgttaaggaaataatttaaaaagtgcactttccctcatactgtttgttcttcaatttttttgacttttgtctctcatttgcctgccaatatttacttttcagaagtaattttctttttgtatttctgttcagagattttagccataatcagtgaaagaggttggcaatagcaggcttatagcattttggccacagcagaagcccaggttaggatattaaacttataaattaaagaatgtgttagctatacagccatgagatgctggccgcttaataggagaatactgggccagctcctgtcatctctatttcaacagattgttcttaaaaaggagaaaatatctacacatatcagaggaaaagagagtgggatacaaaataatatatatttggccaagctgtcatttaggaagcagggagacaatatttgtaaaatttgtaaaaaaatcaagaactttgttgccactatccgtcttcagtaaaactgttcttagacaagataaagcaatatgaggaactctgaaatgttataggaatgtgctgtgtgaaaaaggtagtcagcatttaaaacatcaataaagaaatacagaatgaacaattgtggatattatggttatgaaataaaataaagcataaatcttaacattgtttattgaagatagtatgtgttatacgattgcaatttaaaaaatatgtgtatcaatctctccattaatatacctgtctgtatttaaatttgcatgtgcatatacacatgtaaatttatacacatgtaaattcacacatactacacacacagatgttagaattgaagctttatagtgttgattatgaaaaggaattattgcttttataatcacataaaacactttaatatcaaacacttaactttatttgagctggtggttttacatgtttcttttgaggacacatttatatttaaatctgatgcttaacctgtaaacatgaagggtttcatatggaaaaataaacaggttatggttgtagataatagaggaatatttaggaatatacaatattttctgaggttatagataatatttcactagaaaaacgtgaattcaatggaaatagaatctttgttattaaaaagtattggagctattctatggctatggaatacagattatgatgggctcatcaattttcattatagaattggcagattcaagtgcagcaaagtttgaacataatcaaaggtgcactgagttcatctgactgcctcattacctgtttgcatcctgtacaagtagaaagcccgatattgtaagctctcaattaactgaatagggtttgttcgctagcatcaggtattataaatttctctctaacttgagtttgagtagtatcagaggtagtgtggagtaagtgatgtcctccctgtatcttcccattcttctaggataggggaccctgtctggcattgcagcattaatatatgtacatggaataagttgttgaaagataaaagtagatactttgctactttgtgtagaggaggttcttgttatttgtattgtgtttgacatttatttgtttgtttgcttgttgatgccctacgtcatcctctgaatgatttgaggcatctgtaatgaatacatacactatctgtccatttttcttctctctgtttcacataatcttacaatttgagatattatcaataaattacatgtcaatatgaaaatagacataaatgataacaatcaagaacactgagataacagggataaaggaatgtcaaaaacattgacaattaggaagaaatagaaacatccagaatttccacgaatactgcagatatgacgcagtaaaatccaagacacactgctcggtatgcaaagccttatgtcatatttaatggcttttcagttgagtgatggtgactgattccatgcatccatgacctgagggatatttattacaacaaagatctgttcttctggggtctagttatttgggcatctgatttagtgagcacatctatttccaatactttccactaaccttgtattgacagttttagacctgctgagtccaaggctgacatagaccaacactgcagcctagttagcaaggcttatctaaggcaactgagtgttgaacagaggggcctgacctttggtgacaattgaaatgtaaggtcagtcagagactcagtactgaacattaagccaaatgaaccagctgtggaaagggttaggctcaagctgtgaaaccaggagttcctccaccagtgttgctgagccaagggcatagatgctagaagttagacccaggagggttcaccacaaggccacagttcatatcaactaattgtatactcttaaatacaaatcaggcttataaacccaggatccctttcagaatctcaatcacctaaggttaggctagttgttaagctcatttgctctagatttttattttgaaaatgcataattagactttttttttttttttgagatggagtctcattctgtcacctaggctggagtaaagttgcacaatcttggctcactgcaacctccgcctcctgggttcaagtgattctcctgcctcagcctcccaagtagctgggactgcaggcgcgcaccaccatgcccagctaatttttgtattttgggtagagacaggttttctccatgttggccaggctggtctcgaactcctgacctcaaatgatccgcctgcctcggcctccaaaagtactgggatttacaggtgcgagccactgcacctggcttaattagacattttttatccagggatctacaaaaatatttctgagaagatgcactctgctataaggtatcttgcaaaaagagaaatgaaaacaatctttgcccaaaatgttacacagttagatttaatatagtcccatttggtgtagcaatttatttccttctccacttaaagaacccctgtaagctaggcattgtctaaggcatgagaggagctagacatgggcacattattcaaagccatacaaaacattaatacaggtggataatctattatttgaaatattttgggaccagaagtgtttcagattttggattctttttctcagattttggaatgcttgcattacacttactggttaaccatcccaaatctgaaaatccctaatccaaaatactccaatgaacatttccttttaatctcatgtcggcattcaaaatgttttaaattttggaaacttggattttggatttttagattaggatgattcaacttgtaccagactgaatagaaaatgtagcaacatgctaaggaagtcataaataggataaataagatttagttgtgaccataaatggaagatgttgctgataaggaccatgaaatctggaagatccaacttttgcgtaaatagcacatgtcacttagaaagcatgtattatatgccaatttctgggtactctccacagactattttacttattttaaaaaaaattttacaggtggaaaaacagaaaaaaattaattttcccaatatataacaaaacttcagtgatgtagcagaactaggattcagatgcacagcttgaggaagttgcatcaggcttcttagatacttgtagaaaataaactgtatgatcattacactattgttgcacggggctagtcatttagtaggagcttaatacatttctctttttctgtaaagccatctttctgtctttgttgaatgaatgagtgtaacaatcactgtggaaaatagaggagggagtcaaaaaaagaaaaatgtatgtttaaaaaacagagtaaacagttgagtttacatagcttcctttttttctcccctaaactgtggaaatatccaggtaaggttggtaagtaagagaagctgaaaaacgaaaacatcaagggtacttattaaatgagggtgatggccagcttatccattgccacggctgacgcagccgtctgtgaggtctactttggcaatttgctctttagagatcttttctgtgcatgggcttcctgcctgaggttggatctgttcaacatggccttgccacttaaatgtgacaccaagccatctgatatgcccagatgaagaacgacaaagtaatcagataagtttataatctcaatgcacagttagaaaacatctggctattacagatgatttagactcatctatgatattaatattggtcttcatcccatgatatttccaggacacagacaggggtattttgcaagctgttactgatctatttgctaatatgtaaacaaattttcctgtgctcttctggatgattgtagcacagagaattgatttatagtgttttgtcaagacctccaatgtcctagattgaacaagtgagtgctgacttagtgtgactgtactggaagtctgtgaggagctggagataaatggaaatgtcaccaggatgcatggatgcctgtctctctgctacccttcacttcctctttccttagccatgaagctttgctaattaaattgaccttccttttttgataatctgaatataaatattgacaccatgctcagtattgtgagacaaacaaggaggatttaggctactaatgtcaatttcataaataattgattgcaaaaataatgaagatagtagtagttgtagtagtagaagtaattacagtagtagtattagcagcaagaataatcctagcgttcataatagctagcctgattgttgggtaggagatgagcactttgatgttccttacagaaggtttgcttagcaatgagtgaaagctcaggcagaagagtaccatgtggccacagcctggatatggtatatttatatttacccagagtggcctctgatccaatctccttatccccagttaattcctgctatatgagcaacataaattcactcttttaataacaaaccttgggagggctaactctctgggccattacccttcactagaatggaagctacctgtggacaggggctgggttttattcaccagggtatacctaggggacacccagtacagagcctggcacacagatgggattgatgcacatttcttgaataaaagaaccaattatactagtcgctaatgtcagaagaattatgatgtggtcaacttatttcctgatgttacctccacaacagccaagtttccaaggaatgagtagaacatgggagattccaggcacagggctcttggtcttagggagcaaggttgagctacaggaacatggtgagtgattgaagaaggccacaggaaagccaaacgggacaatcatctggacaaattaagttccagattttgcaacaatcatgaccatttatttagtcaacactttagtaggtacagaaaatactgctaagcgctctatcctattttatctttccagtgaatagatgaaagcagattattattccaattttatagttaaagattccaaggtttatagaggcttattgtgttgctctaggaaacaaagctaaagaataagattgtgtgtgtgtgtgtgtgtgtgtgtgtgtgtgtgtgtgtgtgtatatatatattttcagatcaaattgattccaatgctctgaacttaaagcaccaggttacactgagtcattagctagatatttatgtttatactgtccattgtttctgactttctcttcaattaataataatattaagtgaccatttagtgattttcaaacactgtaacatgtaatttcctgaatcttcgcatttaatcctcataacaagccttcaaattcagtactagtatccccatgcagcaggtgcagaactaaagaacacagtttcacagtttgaccaagatcgtgcagcttgtaagcaatcaacttggcacttgtgacctggctgtctgatactagaataagtgctcttcttaatcactgtgattcattgattcctgaatttaactaatttttggtgacaatatgctaggtaatggaaaagcagtggtgaaacaacaacagtcaaattcccttctccaaagacaatacacaaaacaggtcaagcatgtctgtttgatggtcataagtgctacagagacaaaattgggaaagggtaaagggaggctacaattggaataccagggccaggaataacctcgttttgccaggataagaaggttacaattgagggagccatacagatatctatggtgagtatatattgggccaagggaaaatcaaataaaaaatcctttggatgagactgggcctgatgaaggaaagaaatgggtgatcatatggagtgaacatgggtgggtggtaggagatgatgttagagagataacaggagaccagattgtataaaatgttgccagccacttcaggatttgagcttttatgttgagtgagatcagaagccattggagaatcttatgagaggaataagactatctcattattaaagtggatagtgtgttgtcgacagagcagggagaggtaacaacggaaacacagagacgagagacgaggctattccatgaaatgatggcttggaccaaagtggtaaaggtgtcagggaggaaagtagtcagatattaatatagtttttttttaataagtgagattttgttatgaattgaatatggagtaaggaagaaagagaggagtcaaagagcaactagaaggtgaggagactccagggagaacagtgtggggagatgagtaggtttatgtcagatgtctttatatctattagatgtctactagacatcccagtggaggtatcaaaagggtaatggcctacaggcatttgaaattcaagggagatgtgtggatcagagaggtaaatattgaagtcatcagaatatagttgttattgaaagccattaaatcaggatcaccaggcaagtaagtttagatagagaaaagaaaaaaaaagtgctgctttcaaagttactttgctaacaaagatgttaccaaagaggattataggaattctctgttgtgcttttgcaacttttctgttgcaaaacttttctgttgcctgtaagaaaagagagcattctgtgagtctaaagttagttgaaaatcaaaaattttgaaaacatgttcccacatgtggacatactcccttgggttggatctggcctctttagaaggaaataagatacttgcttattttggtctgaaccccagactttattcagaaagcttatacttgaattatcttcttgaacatcttatcacttcgtcagcttacactgagtttgtggtcaactgagttccaaggcatattctaataatctcttcttaaaccaggtctccctcattgtatctttcaaaaatgaatttactttttgacaaccctgatgatagatcatacattatacataataaatattcttaattgagtttgatacaaacacgaccgagtgctttgggctctgctttcagtgtcatagcatttaccagttaattagcatgccctctatgctgttatctgaggcttccaacattctgtcatcttttagatcactggagaaggtccagggaagcataggtactcacccagagtcagcattttcattgaccaagatctatccatgaactcttttttgctttcatccagctgtgaatttacctaccacaattatccagcagcccacatttattcatgatattattaaatatataatgagggtctctattaaattctttgatgaaataaaaacaccatctgactataacatttcttagtctaccagcccagtaggcctatcaaattatgaagcttgtcttgtcttgactaatttgcaatgaatttacactttacactgccttctagtgatcaatgtattttgttattatagcaccacaaatcatctatttaatagtccttttctactaatccaataatatgaggttgctcatgtgaattatgcaaatataagaatgtcttaggctgggcatggtggctcatggctgtaatcctactgctttgggaggccaaggcaggaggatcacttgagaccaggagtttgagactatcctgggcaatataacaagacccctgtcactgtaaaaaaaataaaaaacagctgggcatggtggcacatgcctggggtcccagctactcaggaggctggtgcaggagaattgcttgagcccaaagttcgaggctgcaataagctgtgatcacatcactacactccagcttgggcaacagagtgagaccctgtcttaaaaaagaaaacaaaagaaaacaaaacaccttgcctaccctttctgttttcgcttattattatttttttatgagaagaaacctggtagacctaacataggggtcttccagagaggtgcatactgtgaagttgtggggttattctttttttaggaagatgagggaacaggcctcataggaatcaaacagaaaatgttactgcctttgtttccgattttatgggcaatagctgtttttgatggtgtagttaaactccacaggaggcagtttaaatggcagaattaaatgtagtttggtgaaaatgtttatcaagtattttcttaaacagtttataatttgcacatttcttttctaaatggcgcttcttcattagtgcagactagagcttgctacagactgctaatgaattatgacacatctattattcatggatcttacaaatttaggtgacattctgaaggtcaccctatggtttataatcccaaatgatcttgttgaagaagctccataatgtcaccaactgtaaccatagtcacctgatttttgccaggtcgtgaccatgctttgtttgcaatggatatgtatttcagtgatatcacagcctcctgagagaaggcacagtgctcagacaagctgtaatggctattctgtgtggtttcatgtggccatgcctagtataggttgtgccccatggttgatgaaataagatgcctagctcatcttctcccccacactgctcctggtcttcctgcatgctggcctcagtgtattgttttctgaaacaaatcatttcttgatttgcttatatttaccaagattttgacagaattgaagacagttggaggaacttgggataatagtaatgtagggattgtaaggcattcgggaaaataaatagcaacagcaaatacttttatgctccaggcagtgggctaaatgcttttcatgtgttatctcatttaatccccacaacaaccctatggagatgggaactgttttacaggtgagaaaactaagggcagaaatgtcaaattgtccaacatcactgagttgttcagtgataaaactgtgatgccagccgttgtcctatggtcccagagcccccgctcctgatcactatgcagtgccaccacgtagcttttcgctgatggagaccatgccaaacatgaattctaactgtgtgttcagagatggtgttcagcaattttaatgtgattagatgcaaccgtgtgatactgctgatatctgactatttttacataaaaagatgtggtgatttgggttatgaaaaactgagagactgaggaaatgacaacaattgcaagcaactgagaagacctgctgaatcgatgcaacatgatacattggattggaccctggaacagataaaagacatcagtgaaaatactggtgacatctgaataaggtctatagtttagctcatagtggtgaaccaatgtaaatttcctggttttgataattgcactaggtaagatgttaattttaggggaagcaaggtgaagggtatgtgaaaatactctgcagtatatttgcaacttttctgtaaatctagaattattgcaaaatacagttctatttagaaagtcaaatcaacagataatttcatgtggtttaaccttaattatatatttacaaagatcttaaatatttgtaacaatcacttcttatttaattatagaaacatgtatgctttctttaattatcatcctgtaaccaccagccttctccctactccccagctctaggcaaccactaatctactttgtctgtctatcagtctccctgctctggacgttttacatgaatggaattctgtaatatgtggtcttttgtgactgacatctttgatttagcgtaatgttttcaaggatcattcgtctatcatcactttgttcctttttatggacaaacaatattccattgcatagatataccccattttgttcattcatctcttaggtgatgcatatttgagttgttcacaccttttggctattatgaataatgctactgtaacattagtgtgccaatttctttgtgggaaaatattttcatttcttttagatatatacttagttttaattcaattacttctaactcgaccccggaggaaagtctcttggagagaaggaataaaagaacctgaacgtgctaaaaaattcaaattattttcagagattactacctctgtgagtctcagtttattagcatcctttatagataagctgtgcctgtaagaaaagaggggtagtaaacaaacacgtatacacacacatgcttgcacaagcatgtcgtcaaaagtgtctccttcaaagaagacttctggagaaaaaaagcataaaccttctcaagctattgccattgttcgggaaattgggtaattcatctttaggaatttcttctgactgatatttggtcatactagaaaaactgaccatttctaacagcttttgcccctgcttaaacaagattgcttctggccatctctaaaaattaaatttcccctggaaactgttctttcatgatgtgtttttggaatattggctgtggttaggagggtaagctcctcaagggccaagcctgtttcctcctttctggcagagcaccttcatacaacgcaagtactcaacgtgtttgctaaactgacatcaattgaaatcattgaatcatagcacttttttggaggacgtgtctgtcttctcaatcgctcagttttcttttggaaaaaggcaggttatagagcaattcattaatcatttgctgtcccaatgttccttcctgcttttaatagcaaaaatgagtcaagacctgatcttctgaacacatcacttgctgcctacatgaggcagtggagacttagagtacccctgtggcctgctcctcctacatctcttcttttgatccctagtccttgctgaccttctgtagaggcttattcacccagcttgtgggttgaggtgatgctttcttcctatttactgagagcttccccacctctccctagatactgcataaatgcaaggaaatttccaagaggccccttcaagtataaccacagcttttcaatcatttgacattttggtcatagagcagaaccaaattatgtagtcaactatagacaccatgcctgattgaaacttgtatcaaaaatcccaagaactccaataactcttagttttactttgtactgtttttaaggaggctgatttacagcagccttttttctgaattttatttgaggaaaaatatgccctcctgccatcattccagctcctgtgacactgaggcctttggttcccttacttatatcagggtatctggggcttggttgttaatttggtgtaatgtgattaattgagacaggcatacactcaggcctaaaagataatcaaatccagaaggggaaactgaggtcctgaaagggaaaaatgggcatttacactagagtcaaaagtggatatcaggggtttggtcctgttatagaaaagttctttttctgacatttcttgatgttctatctagcctagtggactagcactaagtactgggtgactgctcagtaaatgcctctggtgggcagatggcacagaagtgcttaggggatgttctgcctcatacagagcatccaactctcctacatggatggagactcacatgatcctggtccctgcagagaaaatctgtgcatttaccacaactttgactcctaagaagctctgactttttgactaaagtcaatgggggtattttgtcagcaggcacctttaaccaggctacacttacaaattcttgtaaatcaaattttgtacaagtagatacttttataacccatcatattttaacctcaacaaagtggattctttacatccagaaatgaaacaataatgactacattattccaaaaaaaatttttttagtagttagatccaggtggatttgatggcctgattttgtcccttatactttgatatatagtatccctttatttatttaccacaagaaaaaaacccttaaaaggagggaaggagggcatctttaatagccaagcttaaaattaaaggcgactgaaatattaattcttaaacagcgctctggtttcctgagtagccaagaaagcactatttagctctttttttagactttacaggaataggaagtgctatgtatcaacatttaatttagaaactatgaatgctttcagatatgccatcttaaatgtttttacttagggtgagggttatttcagtgacatttactttgtttttgggcataattagaggatgaggatctcatataagtgcattttaaaataacgaaagcttgctcatttaagagcctatattttttatttcaaatgtttctgaagtaaatcttttaaaaatgtaattgtccaatcatttccttttgtaaacaaaagtgtttaatagacatataactcttcctaatggtccatggcaggacgcccaagtgaatctttgtgtctgggaaacttagatttgaagagaaccccagttcacccagtccatctccctcatcttcctgcccgatttatagaagaaagatttgaggagctacttccagccaaatgccctgagatttcttcggtactcttctccttccagacatccatgacctggagctttgctttcattatagaagtgctcagttgctcaggctttgccctcaacaagctgcaacccactctctttctagggttcacctcaaggagctgctgactggcccccaatgcagccccacaatgtacccctacagctcttgcacacccacttttctgtctgggattcctttccatctggtccaccttagatggccgatagccaccttgctttatctgtcataggtcatatttaaggataatttcctctggggaactttccaactcccccaggcggaaatagttcctccctacattacatccttgattttctctatgagttctcctctctcagctcttggccacatttgtaccataccttgagtgtccatctgtctttgctcactcactcattgagcttaaggattcaatccaactcatctttcctgttcccaatctgataactagcagctctctatggggataaattaattgtgggacaaagaagatactctaaatccacatcactcactcacttccaatccctctcagatgagcttcttttaatttaattcttatcaagttcttttaatttaatttttgtcaaatacttgatatcttgaatgatgaggagagaattggagagtctctgtgtgtgtgtctctgtgtgtaggaagacaagtcacatattctcaccctgagacatagtttttttctgccagccaaggagaaggagcttcctgcccatcagagaccccaccctttttacctggcagggtgtgctgtgaggcattgcccagagtgtcttgtgcaacttggggaaacgttgaaatcacaacctacagctaacaggaactactgaaccttacagagttttgtagcccatgcctaatattaatatactctgtctcctagatcacctcaaagtagtgaattttagctcttttgtctgcatgtctgcaccatgcgtatttgttgccatttgttttcattgccattgtgaagccacactgcctgtgcttacatttcgccttcattacttgatcattcaacctctcagttcttctgtttcctcactgataaaaatggtggtgtaaagactaaatggattattgtacagaaaatgttgggaagagggccggtagcaccaacacagcctgaagcatgctcgctattattactgttaagatgactgtccaacttggaaccctcacttcctgactcactgttattgtcttgggatttgctttgtctaccctctggtagctggtagaatcagactggctcaattgactgtaataagtaaggccagagtgattaggcttttagtaaggactctaaaaaaaaaaaaaaaactaaaaaatctatatgtgctctggagcacatataattttaggctgtgggttagcatccaggggccctcttttttcctttctgattcatgcctctgttaagaatagtcgaagttgccagaaaagtgatttttgtataagtaagagaggtgagatcatgttaaattaggaatcagagtcaagaaaagatgagaagctttatttagaatgagatttgggctgaaaatgactgtagatgtttttcttttttaatagtgtgagaaatacagccacaggtttgaaatggaactatttaaacgtttattttagcctagttgaaaaaagaagagagccagtctcttcctagacctgaacaatttatctttaggatgtataaagaaagtgagagactgcatgaccttgttttctctgaaattttcgctaccttgctttctgtctcttttttgctttttttgaggggggataatgtgtattgttaatgctgaaaatagtaaatgatttttttttctttgcaatagatgtggaaagttaataaaaaacaggcatcatagcctatgcaagtgtgttacagagtacagctaggtgagtgactcctgatgagccttttctccatagttctggaatcccatagactgatcatatctagatccagagttgcctatagttggtccttcaaacaggctggcctgtccgcagaacatttacagacacagtctggcctctaggcaaagttctcaactgagtgtcctgcttaaaggcaagttgtgaatttctttttaatttttattttattgtaaattgacaacttataatttcatgtatttatgaggtacaaagtgatgtttgatttatgaatgcaatgtgcaatacttaaataaatgtaacaaatatatcaatacatcaaacacttattttttgtggtgagaacatttaaaattatgaaaagatgaaatattgaattatgaaattatgaaatatacaatactgtattcttaaccatatttaccatgctgtgcaatagacctcaaaaccactgtaacaacgacaacaatgtctcctatctgaggttgagtttggttcttgaaatttgtctctctctttctttctctattgacttatctagctccctgaatatttttactgatttcacaaaaaaagttataaaatgatggaaggttttatctgccttgctcatttaatcttcacaatagccatgttagatacacatcattacccttattctaaagataaataaatggaggcatgaaaaatataaataagttacccaactttatagccagaaagtgttaaagtgagaactatagcagggtctttctgaccctggggatcttgtgttcttggctactcactacctagaaaccctaaataaattaagttctaaacttatgagatttttgccaaatgatacatagctgccaaaaaagaaccacttgaatttggacaaatatattcctgtaaatatacagggaggcttctttatcttttgacttgttatcagcttgactctcttattgataaagtggcaccatgttgagaaagagtgaaaataaagttttatgtgttacagtatttctaaaatttggaatgacgtttctgaaaacacgagcacctcttgtcctcctttctgccatccttgaatagaaatgatatggctggaaattcagggtaatggagaaagaaccctgtgctatttgtcacgacctctacttctgtgattcctccccctaaatacaaagataatgttttaagggaatatgacacagttacttcctaaaataaatgaagaattttaatgtaaatgaacgtattattttaaagaaagatggattatgatggtctgttggataaattcaggaaaagaactctttgcctaaaattacccagcctgttcaagatgcagtgatatatatggaacagctcctccacagaaagtccgagccgtttcttctcccagaaagtgacccagtaaaaatgctaaatatacacccaggtcctctctaactgtataggcaataatggaaagagatgactcagccttgtaacgacaggagacccgtggaaatggtttcttttactggagttggtctaaatttctgttttgttaaaagttttaggctatttaaaatcaatagtaatatttaacctatattttacaaaaaagaaatacatttgtttctttaaagaagttcagagatagctgactaatgagcttattaacccagggtttataatagaatgctgaaattatacacaggataagatgcatgatacctccttggctttggttttcttattttttcagggaatcacataagtcaagttagatattaaatttgcctgtatacatttatttttaaagaagatgtttcaggatatttcaattgtactgtctacaaagaatacctctggcatccaaaatggaattacctcttttgagggaccaaattgcacagaaaaccaggataagattctatctagtcatacaaatgcaagaaggtttgcttggcatttctgtggactaatattgaattccatggagtcagttgccaagagctggagattcagggtcatggatatgcttcccacagctccttctctgcatacggggagtctcattactgcctgtctgtattcctgcacatgcctccgtacccatgtttctgcctgtttcttcttcttcttccctttttttcatttgctgaaataatggatgccagtttaacttactttgttttgaagcagtacgatcaaaatctgttccagtgtacctacagcatccccactgccatgatgtaatatttgtctccatcattccagttactctacagacagttccaactggtaaattctctggtgctcgatgcctcagtgaaacttacccatctgctctgtgtaactccagtaaaccctagattccaccaccacagtttagtctggctgcaggacattcttcctcttacaccctcttgctcctggtgacatcataatcatcttctaacattggtcctcaatttcacccacctcccagatactttcaaaggagttgtatgagagagggatggggcatagactaagggacacatattggatctgccattgtacctgtaagcaattgacttgatcaatgtcttggtttcctcagttttaaacttggaagaaatagtccctcaaagagagaattcaggaacataccctacatgaactgctttctgcagagtagacagtaatgaggggtcaattcctgttttcttcccaacactcactgctttcctcattaggattgcgtgtcctctggtgctactagagaactgaacattgcatcgtttgaactttagatgacatgttagagttttgggagatattggggctttgtgctgactttttggttttattttattttgttttgtttttgagacaaggccttgctctgttgcccaggctggagtgcagtgatgaaatcatagctcactgcagcctcaaacttctgggctcaaacggtcctcccacctcagcctccagagtagctgggactacaggtacatgcctggctattttttaaattttttttatagagatggtgtctcactgtgttgcacagactagtttcaaacccctgggctccagcaatcctcctgttttggcctcccaaagtgctaggattataggcatgagccatcatggctgtcctgtgcttacttcatgtgactgttttataacaaccccccaactccaagcaggaatatatgttttgcttctttctgttcctagcagtatgaccttgagtaagtcattctcaaggtcatactgtggttcagtctcatcggtaaaatgaggctaacaatagcactgactcttgagttgctgtgaggattatatgaattcacacacgtatttagaatagtgcctcacatggagtaagtgctctatccctttatgtttaatagtaactgattttttaattataaaaccttggtcctctgtggttcttataccaaactttttgcatgggtagggcactgatcttcttcatagcagtcagaaatcccatcattttagccaagttagttttttccccttggcatttggtttgctgctggcatagtatttgcttttcctgcttttgcttatggcacagatgcatgagttagcatgactcggactggtatgttagtgtgtttttgctccgtagtttgtcttcacagatacttggtcaaacttggccattacacagtctgatgatagctctgtttcctttatgttatcattctttcagtaatgagagttgaattctttctctctcctgcctcagatcctcaggtgacattgcacaagggcagctgcagccaatgccttgtccaggcagttatattagtgttatttctagacattgtctgccctgaatacctgttagcttcctgatcttggcatactagtctgaatgagataaaaggaaacataatggtctccagtgtataggattatttgactaaacaggaacttgccatgtgttatgtgtgtcaacaaattctcatttttcatgagttctttcaactctcttattaatttcctgtgatacaagctaatatttctggctctacaacccaacttctttttactacatgatgtccgctgtcattataacacctcttaatctctctttctgtctcttcctcaatccccaaatctgctctgtgttacctgctcagatttctctataagagaatagatcctaagccaaatattactttggcagtgaaaaaaaaaaacacataagaacaccaagtgaaaagctggtgaaatggattcacgtggaactatctttaaatcttggcaccacaatttttaccttgggaaattatgaactttggtctcctatgttattttaagacagaataagtagtatacccagagtacctgttacctttaaacatggctcagtaattgaaaggcatattactagaagtatttggagataattataatacttggaatatcaacagataaaaatactagttgatttttcccctgaacttcagagacactcatttgacctccaaaatagaatgccttgttcttgatactcattttttcgtttaatacattcagtgttcctgctgcaggtgccaaatgccagccttgagtttcgtgcttttaagtagaggtatagaaaacacagagcttatggagcccactctttctcagtttatgttactttcactgtgagcacctgcttactgtttggcaaactagacataactgttcagcatctgacggataaccctgctgaggacggacactggcatcctcctccaacacctccttctgtgttcctagtgtttgccctcaaacagtctccctgcaaaggtgggagcacctgaaactaggattgaagaattcagttcatccaaaattctgttctttcttctgctggtgtcattagtttttgaggcaagtctaaatcaaccaaatatagagtctggaattctaatatagtagatctgaatgttggctgaacagtggaatcgtctggaaaaccttaaaaggtataaatgcctggtcccaccccagagctctggagcatctggatctgtatgacctggaaggcagcaattggcattagtttcttccttgctttgctccccgaggttgcttgcattgacaggggaaaccaatttcatttgacatctgatactcaggactgccccgctattctcacccccttcaatgagatgcatactaattagatgtcaagaaaagatcaaatccttcagaccctcaataccactattgcgatgtcatttcaagtattttatctatctacttcatcacagtgatctgctttagatgataggtaacttgttttatctttgagattatattggtagcttaaatttcttggttacatcaccttgaaaggtgtaggttattgggaaattctgaataggatagcgttatggagaattggctttcgaactgatgaatcctgtatttggaatctaccatctttggcaggtaacttgaactctttgggactcttcatccacatctgtaaagtgggattaatagggctgtagtaattattaacttacattggatcagatatattttgtgaaaatccacacctaacccttgcctggaatatatgaagttctcccaaaatatatactttttaccccaatgagtaaggataaaaatatttaacaagtttggctaacacaggaacagaaaaccaaacactgcatgttctcactcgtaagtgaggcggaactttctgttcctacagggaggggaacgtcacacaacggggcctgtcggggggtggagggcaagaggagggagaacattaggacaaatacctaatgcatgaggggcttaaaacctagatgatgggttgatgtgtgcagcaaaccaccatggcacaggtatacctaagtaacaaacctgcatgttctgcacatgtatcccagaacttaaagtaaaaaaaaaaaaaaaagtttaacaagtttggatgccaaatatatgttttctaaggaaaaaaataccacagtataatctgttgctttctttcagccttgtgtcattcatcacagactatttacttgacacagcaaaacatcatatcatctaataatggcccgattgtcagcttctcaatagaccaatcatcatccccatttgacaagcacattttactcagaaatgacatcaaaatgcaatatttttcttgtcaagctgaactatgccatgcctactgactcctgtatattctcaatattcattacccttttacttggtctcacccttttgctgtcaaatcgcctcattttatttatttaataatctgacaaagatgaaagaaatattaccatgggcttatgagacaattgaaatgtcctttactgtcatcattttcatttagatgagagaggcatcccccggtcatgaatttaatttaagcaatgtctgcgtgttgaatgttttgttgtgcagctgtgtcagtgtgtgtgtttatgtgtgtgtgtgtgtttccaaaagtagtttcctgaggtagactttatgtacagccctcagattaagtgatcttcaccaaactctgctctttgttatattgcaaagacattattttaaatcattcagtctataaacctgaaataaaaccttactcaattctaagtggatgtcatttaatcaacataaatcatggctgtatatatttaacattacttaaattctgttaaagttttttgaaaaatgataactagctgggacacctctttttagtaaagataaattctgaagatcttaggcaagtgttcttcaacaaataccatcaatatgctggttaaccccaaatgtatatttttagtcttgacttctattataaggcacagactcctatatcaaattagcattgctttctccaaaatattgaactcatatgaggtatgtctgtgtggctgagatcatactcattatcttccctctccaggtggttccccttccaatgtccccggctcactagaccatgcttatatattctgaatactgcccagatttgtgtaattttctttatcttcaatgttgctaattcaagtcaaggcaccgtcaggtctccctggacttcagtatgctctgtggaagaaagatgtcattctctctgtttagcaattaatctattagatagcaagattattttttcaaaaggcctgtagggagaaagacaaggtgaaagatcttaattgtggtgaccatgaaatttattttacaaacaaggacgcttaagagtgaagggagcaactactgataattattccaggactatcgccatagaaaagattagtcccaggaaactggggtgttggacagccagatcttaatacttttcactagaaagtgaatttcaccattaatgaagacatagacttgaagaattaatgtagaaatgatcgataccttagataataaattaaatatcataaggttgttattaccacttaggaaaataaatttatttttctttaacaaataaattctaaaaatattattccctataatgtataatgagtaaatttaatttttttctacaaacatgtagaacaaacttgcagtaattatagggttatatttcatagaagctgcaacatgagacatacagaacaaaagctgggtggttatgaatcaagccattctagacaatcttttggcccagtagatgtcctagtagatgtttcggtagatcagccacaagttggtgatgacaaggcacagatagtatgcagagatttaattgaaattatcacttcattctgactgctgctctttattctttatagtaattggcatataaatattccttgatgccagaaagaccaaagaattaatttctcctttggccgcttctttgaactggcattttaacctctctacacattcatgtttcttctgttttaaggaagtgatgacatttattctgcctacttcataggactctaggaatatttaatggagtagtacagatgtgagttctctgcaacctgcgtaagttctttgcaaatgattggtgttatcataagtgctagactaccagcagcaaagggaggcctattttgctggttcataagagcccaggttggagacacagttggcagtacagaagggtgccctagtcgtaagctagacaaagccttgctcacagtcttcctctgtcacaatgttataacagtttcagtgaaatttgagatatggcattctcatgactatggtgagaaagttgttttgacttgttgttcaatccttgagcaaaaataagcctttcctaaagtctgcatgctgggtccctaacacttgaaggagatccatgggccatgcggcttcagctccatgcagagggtggctgcaggtgctgcaagggcagcttaagttctggacagtcatctctgttcaatggaatttgtaaggtcaaaaagtagacttaaaaccaaagtgatggggctgggggagtggagaggaatagaccctgcctatgtgaagttagtagtggaatagttctctcctgaaggtaaacctagttttcaaattgctttgtttattggttggcttctctacctgcatgaaaagtttatgcgttttagaacgtggcaaaacaagtggagcatgacttatgtttcataatgtacagagctgatttcctgagttccaggacaatgttcagccctttagtcccttgagaagttggttctctctctctcttatccataccctcctgaaacatacactcctctaaaactcatgttatcaccagaagtgtgataccaaagcttagttaatactttgggcacagatatttggctaacttccttgtaaatatgcacagtaaacctgagtggaagtgtgccaccctttccttcttcccagttggtgccaggacaggtggcatcagcctatcctagccacctgtctccagaaaccccagtctgccccagggtggactccttagcccacactctcagcacagccactgatcttgacaatgcaaaatgcaagcatttcagagacatagtggggcatccccaccctgctaggaccttcctctctcccaccctcttcagtgcttggaggctcggctccataggaaagaaaaagaagagtcactctgtttccttcatcataggaaatttaactacctcattttcaaatcatggagtggttcagtttggaaaagcctcaaagatcacttaaggtactgaaaatttacaaatgggaaaattgaagcccataaatagaaatctcttggctaagatcacgatgttaattaatgactgagttggacttgtgttcaggtctgctgtctagtcattggccttccttctacccgtcgtgattccaatggaagataaaatgtgtgctgggacacattttatcttacctagttccggacaatcatctttattaataatgcaccatcacttaagagtatgtgcataatggcattgcatttattttctttattgatcattatgaatatttcagtgctatttcatttttctaaggactgtcataaatggctaggcatgttttagagatctcaccttaaaaatgtttttaaaaactcaaattgtgtcatgaatatggaagagatacttttcagcagttgctggaaaatgacatgtgcatcccttatattaaaactcttactttctatatgccttcccagtaagtgcctcctgtactccagagaaaaccatttagaggttagattatgataaggaaatgccttttgcatttgttgtggaatgaataaaggatttatatctttaatgctgcattgaacaaatttgcagagaacattaaatattctttaccttgacatttctgatacccatgattttgataacctttgagtcatggattgttgattacaaatgccttatatgcgtctgactcaaaatatgataagaactcaaaccagaagcatttttaaaagcttgtttaaatttctggggttttttttgttcacttcaattatttaaggaatctgaataaacagattagcttttccactttgagtttacaattagggactggaacatttcagccaataataaccatgttgatgataaaagcacactgtgtgtatgctgtcatcttaatttgcttgagatttcggtaccctaaatttttgaaggtggagtctcactctgtcatccaggctggagtgcagtggcgtgatatcggctcactgcaacctcgcctctcgggttcaagcgattctcctgtctcagcctcgcaagtagctgtgattacagatgcctgccaccatgcccagctaatttttctatttttaggagagacggggtttcaccatttcggccaggctggtctcaaactcctgacctcaggtgacccacctgccttggcctcccaaagtgctgggattacaggcataagccactgcgccagggcagtgctctaaatttttaacataatgttctcaatacacagtattcctgtaaaaaccacaatactacattgtcagagggcacagttcacattcaatttccagtgatatatctgatttttattacatgcatggttagtttaaagttagtcttagaactcctttcattctggtttccttatctcctctatagatttccttgttttaattcttatgggtacatagttggtgtatgtatgtatgaggacatgagatattttgatacaggtgtgcaatgcaaaataatcacattagggtaaatgaaatagctatcacctaaagcatttattatttctttgttttatgaacatttcaattatactctttcagttatttatatatattgttgagatggagtctcactctgttgcccaggctggagtgtagtgcagtcatggctcactgcaacctccaccttccagattcaagtaattctcctggctcagcctcccaataggcatgctccaccatgcccggctaatttttgtatttttagtagagacgggatttcatcatgttggtcaggctggtctcgaactcctgacctcaagtgatcctcccacctctgcctcccaaagtgctgggattacaggtgtgagaacccacgcctgtcctagttatttttaaatgtgtaataaattatcattgactgtaatcaccctattctgctatcaaatactagatcttattcattctatcttaactatttttttgtaaccattaaccatccccactttccctgcccattaaccatcactacccttccaagcctctagtaaccatcattctactctctatctccatgcatgcaattgtttaatttttagcttccacagatgagtgagaacatgcaaagtttgtctttctgtgctccactgtgtatatgtatcatattttctttttttttgcttctccattcatattcttttattctatcaattttttagactatatgtatgtatcactttttctttatatatatatatttttattatactttaagttctagggtacatgtatgtgcatgacgtgcaggtttgttgcatatgtatacatgtgccttgttggtgtgctgcacccattaactcgtcatttacattaggtatatttcctaatgctatccctcccctctcccccaaccccacaacaggccccagtgtgtgatgttccccttcctgtgtccaagttcatctgttgatggaaacaggttgcttctaaatcttggctattgtgaatagtgctacaataaacatgggtgtgtggatatctctttgatatactgatttcatttttttgggggggtatatacctagcagtgggattggtggattatatggtagttccatttttagtttcttgaggaacctctatattgttctctatagttgttgtactgatttgccttcctaccacaaagtacaagggttcccttttctccacattctcgccagcatttgttattgcctgtctttggataaaagccattttgactggggtgagatgatatctcattgtagttttgatttgcatttctctggtgatcagtgttgttaagcaccttttcatctgcctgtttgccattcgtgtgtctttttttgagaaatttctattcagattttttgcccattttaaaatcagattactggacttttttcctatggagttgtttgagctccttatgtattctggttattaatcccttgccacatggataatttgcaaatatttccttccattctgtaggttgtcaattcactttgttgattgttttctttgcagtgcagatgctttttaatttgatgtgatcttctttgtctatttttgctttggttgcctgtgcttgtggtgtattactcaagcaatatttactctgacaaatatcctagaaagtatccccaatgttctcttttagtattttcattgtttgaggtcttagatttaagtatttaatccattttgatttgatttctgtatatggcaagagataggggtctaatttcattgttctgcatatggatatccagttttcccagcactatttaaagagactaccctttccccaatgtatgttcttagcttgtttgttgaaaattagttcactgtaggtgtatggatttatttctgggttctctattctgttccattagtctatatgtctgtttttatgtatccatgctgtttgggttacaatagctctgtaatatactttgaggtcaagtaatgtgattcctccagtttttttctttttgcccaggttggctttgggtattctgggtcttttgtggtttccctatcaaatttaggattattttttctatttctgtgaagaatgttattggtattatgataggtgttctatcaaatctgtatattgctttgggtagtttggcattttaacaatactgattcttgcaatccatgaacatggaatatctttattttttgttctctctgtaatttcttgcatcaatgttgtatagttttcattgtagataactttaatttctttggttaagtttattcctaggtatttaattttatttgtagctattgtaaatgagattacttttttatttctttttcagattgttttctgttggcatatagaaatgctattgatgtgtgtatgttgattttatgttttccaactttgctcagtttgtttatcagtagtaatagtttttttggtgcagtcttcagacgtttccaaatgtaagattatatcatctgcaagcaaggataatttgatctcttcctttccaaattggttgccatttatttctgtctcttgtctgagtgctctacctagagtttccagtactatgttgaataacagtggagaaagtgggcattcttatcttgtaccagctcttagaggtaaggctttcagttgttccctgtttagtatgatactagctgtgggtctgtcatatatgacttttattgtgttgagatatgtttcttccatacccagttttataagtatttttattatgaagggatattaaattttaacaaatgcattttcaatatcaatggaaataatcatatggtttttgttcctcattctgttaatatgatgttatcgtgttgattgatttgcatatgttgaaccatctttgcatccctggaataaatcccaagtggtcatgatgaatgattgttttaatatgttattgaatgcagtttgctaatatcttttatatatatatgatatatatgatatatatatgatatatatatatgatatatatatatcatatatatatgatatatatgatatatatatgatatatatatatctttgtctggttttgttatcagagtaatacgggcctaatagaagtttggaagtatttcctcctcctcctctaatttttggaatagtttaagtaggattggtattagttcttcattaaatatttggtaaaattcagcggtgaagccgtctggtcttgggcctttctttgctgcgatactttttattacagctttgatctcattacttgttattcgtctattcaggttttggatttcttcatgtttcaatcttggtaggttgtatgtatctaggaatttatccttttcttgtaggtttttcaatttattgacatatatttgctcatattaatctctaattattctttgaatttcttcaatataaattatgacatatctttttcaatctctgatttatttggatcttctctttttgtagttagtttagctaaagttttgttgattttgtttatttttacaaaaaatcaacttcattttgttgattttttgtattttttatttcaattttatttatttctgctatattctttattatttcttttcttctactaattttagattttgtttgttcttgcttttctatttctttaaaatgcatcattaagttgtttatttgaaatttttctacttttttgatgtaggctcttattgctagaaacttttctcttagcactgcttttgctgtacctcatatttttttaacattgttattttgaaaaacttttattttaggtttggggatatatgtgaaggtttgttacatacataaactcatgacacaggggttgttttacagattatttcatcacccaggaattaagtcccatacccaatagttatattttctgttcgtctccctcctgccaccctgcaccctcaagtagacccccgtgcctgttgtttccttctttgtattcataagttctcttcatttagctcccacttatatgtgagaacatgtggtatttggtattctgcttctgcattagtttactgaggacagtagcctccagctccatccatattctcaccaaagacataatctccttcttttttatggctgcatagtattccatggtgtatatgtaccacgttttctttatattgtctatcatcagtgggcagttaggttgattccatgtctttgctattgtgaatagtgctgcaatgaacattcacatgcatgtgtatttatagtagaatgatgtatatttctctgggtggtatatacccggtaatgggattgctggatggaatggaagttctacttttagctctttgaggaatcgccatactgccttccacaatggttgaattaatgtacacttccatcaagagtgtatttgtgttcccttttctctgcaacctcaccagcatatgttattttttggcttttaaataatggccattctgactggtgtgggatggtatctcattgtgggtttgatttgcatttctctaatgatcactgatattgtgcttttttcatatgcttgttggctgcatgtatgtcttcttttgagaagtgtctgttcatgtcctttgcccactttttgatggggttgtttgtttttctcttgtaaatttaaattctttataggtgctggatattagacctttgtcacatgcatagtttgcaaaaatttactcccattctgtaagttgtcttgtttactctgttgaaagtttcttttcctgtgcagacgctcttaagttaattagatcccacttgtcaatttttgctttcgtagcgatttcttttggtgtctgtcatgaaatttttgctttttcctatgtctaggatggtaatgactaggctgtcttccaaggtttttatagtttggggttttatatttacacctttaatccatcttgaattgattttggtatatcgtataaggaaagggtccagcttcagtcttctgcttatggctggccagttatcccagcatcatttattgaatagagagtcttttccccattgcttgtttttgtcagctgtgttgaagatcaggtggtcataaatgtgttgccttatttctggactctctgttctgttctattggtctgtgtgcctgtttttgcatcagtattatgctattttggttattgtagccctgtagtatagtttgaaggtgggcaacatgatgcctccagctttgttctttttgcttaggattgccttggctattcgggctcttttttggttccatatgaattttaaaattcatataaaatttaaatttaaatttatgttcatctaaattttaaatttaaatttatataaaaatttcagccagacatggtggctcatgcctgtaatcccagtactttgggaggctgaggcaggcagatcacctgaggtcaggagttcaagaccagcccagccaacatggtgaaacctcatctctactaaaaaataccacaaaattagccaggcgtggtggcacatgcctgtagtcccagctactcgggaggctgaggcaggagaatcatttgaacctgggaggtggaggttgcagtgagccgagatcacacaactgcactccaaccagtgtgagtgggactccctctcaaaaaaaaaaaaaaaaattccatatgaaattaaaaattttaatatctttcctggattatagggtttccactgagaattctgctgccacatattctaaagcttcattgtatgttatttctttctttctcctgctgcttttaggatccttttttatccttgatctttggtagtttgattgttaaatgtcttgaggtaggcttctttaggctaaatctgcttggcatgctgtaactttctttaattgactattgatatctttctctagattttgaaagctctctgttattatccctttaaataaactttctaccccatttctctctctacttcctttttaaggcaaataactcttggatatgcccctttgagactattttctagatttggtagatgtgcttcattctttttgcttttgttttctctgaccttgtattttgtaatagcctgtcttcaggctcactaattctgtcatctgcttgccctattctgcttttgagagagtctgatgcattcttgaatatgtcagttgaatttttcagccttagaatttcttcttgatttttaaaaatgatttcaatcttttcgttaaatttatctgataggattctgaatttcttctttgtattttcttgaattttgtcaagcttccttaaaacagcaattttgaattctctgtctgaaatgtcacatatctctgtcactctgggattggccactggtgccttatttggtttgttttgtgaggtcatctttcctgaatggtcttgatgcttgaggatattcgtcaatgtctaggcattgaagagttgggtattttttgtagtctttgcagcctaggcttctttgtacccattcttctaggaaaggcttttcatgtattcaaatggaatagagtgctgtgatctaagtttttttgtcactgcaaccttatcagcattaggggacacaccaagcccagtaacactgacttgcagattcacagaggtagtgccttggtggtcttgggtaaaacctgagagaattctctggattaccaggcagagattcctgttttcttctcttactttccctcaaacaaatgaggtcattctcctctgtgctgagctgccttcagctgagggaggtgctaccaccattggaactgctctggttcagacttagagccagcatagcactgggtctctctcaaggcccacagcaaccattgcctggctcccacctatgttcattcaaggcccaagggctcttcattcagcatgtggaaatccagccaggcgtgtgtccttctctttattgatgtgagctcccttcagcccagggagagtccagaaatgccatgcacaagccatggcctggagtcagaaacattaggaatctacttgatgctccattttactgcagttgagctggtagcaaagccacaatacaatgttttttctactcctctctttcctcaagtaggagtctctccctgtgtccaccatagttatcaatgttctgggttacaccagaagccagtactgtatgcgggtctcacccaagtcccatggcaagtactgcctagctatctctgatgtttattcaggacccaagggctctttattcagcagaacttgggttctcaccactgggatggatgactcccctctggctagggctggtataaatgctccctccgtgggttcaggctgaattctgccatgttgctttccactctgacagacagcatcaagttctaatgcgaagtctcacaatcactgtactctttcaaacacatagattcttcataccacgtggctgctgctgggagatgagagaggggtaacgtaggcttcaagactgtctttcctaccctcttcagtacctctttcattaatatgatgtcaaaacaaggtactgtgattactcacctgattttgttttttctggaggtgctttcttgtgtggatagttgttcaatttgatgttcgtgtgggggaaacaaatgttggagggttctatttggtcatcttgttccccctccctaagctcctctgtagattttgaataccaatactcgtgagcttgttacacatcagtaagtaagaggtgtagaagaaaggaaatagcagaaaagacacttgagattctcagtcaggattgcgcttttagaaccaactctctgctctgagcctttatgttgtgagacgataaaaatgtaatatttaaattcatgctaagccgaagtgccagaatattaactaaatgcaggtgatgttatcttcctcccacaatactattattttaactgatcttaaacataaatggaaacacagctccagctagcacatttcctatatttaagccaccccatcatgaaaaaataaataggttcatgtaggaattggtaaagttccacagcttgaggcagaaattactgtttggtagcctatctgatcagttatttagacacattcgtaaacagatcagattattgatccatagaactaattgattcaagaaaacggcatttagtgaaattgaaatatcagaatttatgtcctgtctcagaatcactgggccaaaaaacataacccaggctttagtattaaaagattggagcagcaagaatttgttatgcatccactctgtgcctgaggctctgctgagcactgtagacacaggcagagtcatatactacagacagaatgttaagggtttataatccaggggatttaagttaaataccccagaatctatttcactctaaaactgaatgctaacatgcccttagtgcttttttcatgtaactcagaatgatccttgtccttaacttgggtaagtccgaagtttgacattcaggctactggtattttctcatcacttgacaatacataaagaagttaaacaaagagagtaatcagttttctgctttttgtttctcaaagttcaattttcattgccctctatagctgaagatatacagttttctaagttgtgagaaacaaatcctgtttatctatgattttccttaattcaaatacatctgtgtttagttgaaaaaaatgtgtatatgtgtgtgtgtgttttgtcttgctcttttacttatcccttcttcttgtccccagccctctgcaccagacttatttgaaaacatttttcctgggggaaaaatatgtctttagaaaagtacaaaatgcccaaaggtaggatacatttaatatgaaagaaataattattagctaacttaaatacctaatttccaagttggcttactatattggcccacatagaaagagacacctcttctgattaaagcaagcaagaccatttggtactatcttcttggcttctaatcatcctctttatagagtgatactactgacagtgggatattatacatatgaagtgtattagtcaggttctctagagggacagaactaataggatacatgtatatatgaaagggagtttattaaggagaattgactcacatgatcacaaggtaaagtcccacgataggccatctgcaagtcgaggagcaaggaattcagtggtgaatcagcgcgagtaccaaaacctcaaaagtaaggaagcctacagtgcagtcttcagtctgtggcccaagagcccctgggaaaccactggtgtaagttcaagagtcccaaagctgaaggacttggagtctaatgttcaagggcaggaagcatccagcttgggagacagatgaagaccagaagactcagcaagtctgctcttccatcttctcctgcttgctttattctagccttgtgggcagctgattagattgtgctcacccagcttgagggagggtctgtctccctctgtccactgactcaaatgttaatctcctttggcaacaccctcaaagacatatccaggaacaatactttgcatctttcaatccaatcaagttgacactcaaccttaaccatcacatgaagtatgtttgtaaataaaaatgaactctgtatcatgataatccaaggtgaaatggacatttacttttctggcaagtctgggtgttttctgcttggaaagcaatggcactaggttgcatatacagcctctaacaagcaagctcctgaaatatgatttctcattgagcaaaatggttattccacacataactgcagtttcagcagtgcctttttgtttctggttattaatttctatttaagttgtgccaaagtcattaatttactgagccaacatggaaaatgtaaggcagttaactttataaatgacaccatcatgcttcagtatatttgtgcttaatgccattataccacgtgaaagattctaatttccttatacttgatgtaactggtggtattagaatgctaagactgtggtagtgtttgttgctttaattgtactgaactgactagatacaagtagcccgttaagtcctcattgtccaatctgaaaactacattattgttaatttttttcttttggaagcatcaagctttctcaatattgtgacacttacattactgttgaagtctttaaggagagaataaatatgctaataacattctagaagcaactaactctaagcaaaagtgaatagtacagcactatcaaggtgtacacttttttccctggaaaattatctccatcaggtaatgggaaagcactgctctacagaaaagcaaaaaatgacttataagcttgattcattgttactttaaaacccttcatatctgaaggttaagctaacattaaggcagtgtacaactatcagaacaatatttcatatatttgtatttagatgaatcaccagatttgttagtctctgaatattttctatattgagccagattttagctgccatttttgtgttttaataaggttttcagttgttatccaaatatgacccagtacctgaatcaaaacagcaagctttgaggaataggtcagtatttttggataaactaacaaaaaaaatgttcatcaggctaagacatcagcagtatttgtggtagaattaatgagtattgttagtgtatattttaactgttaatagtcaatgctctattttttctatgaaaattcaacttcctagtcgactctttgcactccttcattcacttattattttacggatttccctcttgtgtcagatctctagaaattctcacttttcatctggttttacaatcattttctatttttctcagctctagaaaagtctctaaacaactccagggcagaggatccatttgtttaacagtggcttcttgatcaataattgcatgcatgaaacaaagtatcagaaatagtttgctctttacactatcaattggctgatatttaaacaaattgtctttaaagtcactgccgcaattttgtttggcaatggcattttatttaattcatttattaaatgagtttccaaaaattaagacctgaataatttatgacttcttctaatctcaacagaaataagtcaatgctggctgggtgcagtgactcacatctttagtcccaggtacttaggagggtaaggctagatgatcgcttgagcccaggagttgaagactgcagtgaactctgattactatttcactccagcctgggcaacggaaggagaccccgtctcaaaaaaataaaaataaaaagtaaaagaaaagagaaagaaataaaacaatgttaatctgtgtcttggcacgaagtttcacacttccatcaaatgggcatcattttgtgctgctaatgtctcttagggcgattttaaaacaaactaaaaatatgaaacactggatagtgttagccttacctagcttgattttctttgggtgtacatgaatgcaaataaattctacaatttcttaaattcatatatatgtatatatgcacatacatatattcatatatatgtttatgtgtgtgtatatacatgtataggtatggtgagtacatatggggaaccagttgaaggatgtttcttcttttacaagaaaggagagaaaacaatcttcccgaaaagtggtatttactagcatgaaaaaggattgagcttcatataggtagacattactgtatttctatcatagggttatgtgtgtacataatccaatctgtgtttataattcacatacctactctccattattttgatgattcaggaaagtaatttctcaaaatttttccttttgcaaatgtgctttttagataactcactggacctaaacacttggcaggcattagggtcgaccttccctgctgggttgaagaggctctttcatcccccagacctgcagactgaaagtcagccaaagtgctagagattctggcccttatgtacctgctgcctatggacttgagttttacagaaagaaagcattacttggcaaaaacctgctgatcatgtctttccccttggaacctcacagcacaaggcccaggcttactttttgattcagtgatggtgaattgatggactattatagaacttttcacttctgtgaagcagcattgtagtatcagcaccctgcatttctcttaaaataaaaaaaaaatcacagtgattctaggttttaaaaagttgtattattctgccaaaccatcataaaatgctgaatctttctagtcaattttattgcaaataactactgctaaaataaagtagaattaggtaagtaacttttttgataagcatttacattcttaagatgtgctactgttcagtatgtgtgaactcctaagttgccagtacagtgggtgctattgctatactaacgcatttcacctgtcctttacctcctcttccagaggtgcatactacgtgaagttttccaattgctgctgctttatttgcatttagtcacccagccaaaggttctcacattttatgatgctttataaaaagcttcaagagcatattttaaaagcaccctgtcagaccccatgaatacacactctgaatcaattgttacagattgaggccaacaaatattcattttttcaagctttcctggtagctcttactaattcatccaagaacatcttgttgaggaatacacaaaagattttgactgcaggattaacctatttataccaaagctttgtattcctggaatggagcagttgcaaatgctgatgactattgcattaattgatgctttgagatgtagcagtactcaacctgttctctaacatctgacactctgtgggaaaacaaaccaacaaacaaacagcaagaaggagtggttgaaatagcaaatagtcaacctggacagtatctggcctcccaagggaggcagaagtagtcctgagggatcctggggtcaaaatgtggttgtgaaacccagagaggggataagggctgggtgttcagtaggaacagtgggaacacgtgcttctggttgctgtttccttttcacttatcagtttacacgtttctaagcttagagtggggtatcgagaagcagggtctcattgggcatgtattatgctgagctcagctgacttcaggaaacatagcaaagcattataaactgtaaggaagaagacagttacgatagaaaattttatgacaacgtaatgtatctctcatggaagagctgggggatgtcctagtataagaggttctagagtcagcaataagatgtgagagtcctctctctctctctcgctctttttttttttttttttttgagacagagcaagactctatctatctccaggctggaatgcagtggtgcaatcatggctcactgcagcctcaaccttctcccacctcagcctcccaagtagctgagactatgggtgtgtgccaccacacctggctaagtttttttttttttttttttggtttctggtagagacagagtctcactatatttcccaggctgatctggaactcctgggctcaagcgatcctcctgccttggcctctgaaagtgctgggattacagacctgagccactgtgcccagccaagattttcttttttaataacacaaagaccaagaggctccccaaacagaaaagtgatgaatgatatgaacttagtgctaggttccagttcaagaatgcagactgatgctgaaatgatggcacagattgaaaggccaaggacagtttctggcatcaaagcctagggcaaggagttcaggaggcagggggcggagactaaatgcacataagttgaggataataagatgacacagggcagtcactcagaattcagtataccactaatgtgcatgttttgaatgcctcaagtcaggccaaaactattagccttattgagcatgattaggtgtgctgcttttcagacagttactgcaattacatactgtgcagttcagttcagtggttggtatagttaagcaagggggtgcctgtattgaaagattgtggactaggtttgcctgtatttcttgtttaaaagttgattctactgttacatttgttctaaacagttgcatcagtttatattagcagttgatcatctcttgcccattgaaatcaatgtgatttagaagcaagatatagaatctggagttaggtagtcctggggccttcatttaccacccttagtttattgtctgtataaatgtgataaattatgtttaccttataagtgttaaatgagtgagcatgtgtggatatgtggctgggcgcagtggcttacgcctgttatcccagcactttgagagtctcaggcaggcagattgtttcagcccaagaattcgagattggcctgggcaacatggcaaaatcctgtttctataaaaagtacaaaaattagcagggcatggtggtgcacacccgtagtcccagttactcaagagtctgaggtaggagaatcgctggagcctgggaggtcaaggctgcagtgagctgtgattgtgctactgcattccagcctgggcatcagagtgagactttgtcttaaaaaaaaaaaaaagaaaagaaaaaaaaaagaaaaaaaagaaagggcatttacttggaagcattcttggtattcagtaaatattcactgctttctccctttactatttaatattctctggcttcataaaatttgactcttatgacttctgtgctcttattcacgtgaggcttctatttaattatcttgtcaactactatgtggttgatttaaggtatgtgaaacaagcattcatctgttccacatcatgtttctccctgggaccacatctatcttatattaagtgatctttgaagcagctctaataggaattggtcccttgggacaggaaaacacctgctcctgctctctcttgtgctcgcacgtcccaggagtcctgacctgtgtattatcataggcaacaccacccaggacacctggccatcttccattcatggcctcccctttggtgaagaatgtcctcaatatttgtggcaattagcagctattcttgggtaacctttagttaaaagagagtagtctcatgggctaaagactaaaaagaagacgtgtaataaaattccagagaaacaagtcaactctgtcagtgtttatgtgaaaagagatctgggagatcagtgctcagccttccccaacagatgcacaatgttttgtagcagggaattggaaaacaaactttgacttgggattcattgtgtgactcttcattccaccaccaacaatctgtgtgacttcaagcaaaacagctactcctgaacttctgtttcctcctgtataaaaaggggatactgaagcatctaatggtttgttggaaggaatgaactgaagatcagttgtaatgctctaagacaaagctggcttatgataaatgctagtctcattctccttgttgtcttttgagaattgccctttgtttcttttatgaaaataacatttccatctttcccatcccactttttcttttaaaactgcttccctgtacacatggggcagccacccaatagctcctgaagggatatacatgtatctctttaaaggggatgcagctgtctgcattgtttgcattgcttgcacagtggtgggcactggtgtcataacccattgccatagctaagcctttctctttggtatggctggctgtgtgcatgcactagaactcggtatggtgtatttccccagagctcagtcaacaaggaattgctaaaatgaaatgccatttctgctgactgtaaatggaagaccctattttctttcataaatgtgtgaaaattcaaataattaccctactatttgatgtccaagttggtaaagatcaactagcagtaagtcccagcatttagttataacatatttgacttttgctttgagcccaagaatcttcaacatacttggctgtaaaatgggaatatcaaagctcatgtgttctcacatgatttttatggaaagcaaatgtataatgtacctgacaaggagacataggtatttgtgtgatggcctcaacatcatattaaaaccaccagtgattttcttattgatatgttaatctcttatcacatgggaacttttttctttgatggtcagtttgctttcatcttgaaagaaatcaattgttgatgtacgctgtgtgttaattgcttcgttaatactgctctggtacaataaccaactgtagctgaaataatttggcatgttcagtactgttcacgttggatagtaagtattgtgtggttaaaatgaagatatctatggcaaacttgcaacaatcccaaaacattgcttttctggttatatatccagaggcagttttttttttcccatattcattagtggtcatcgctctccacaggccattgcaatagataagtaggtagtaaccagggtaaagaattaggttgcctagaaggtcagtgaaccatacagaacttgcatatgactagctgatgcctagttgttgaggtgaacattgtgataaaatcatatttgctgggagtggctgacagaaaatattttgtgagtgagttaaacacctcacatcttgacataaggcatgtatcaagctgtttatgacagcatctgattcagaaaaagtacttttttcagtattaaccatccaatgcaaatatttaaagcctgcttttgtttctatcaaagagaatgttgggacagagattgtaaaagagaatagagcctgcatattttcagatcctactgaaatacagctaaacttagattgtttatagagaattgcacatttcaatattttagtatttgtcttactccaaatgtcgtttgggttgtctgggattttatccttggaatatattgcaagtgatctctgtgttattcgcctcagctcctgaattctgatttatcgtctctagtaagcaagccagtgagcatcacacaggagattctcagggctcagtcattcaagaagtgtggactgttgaaatttaggctttgtgtacaatctgggtaacaaaccgtaaaggcatgttttcttcctaaagctctatggaaaagtcatttgccatattacttcccccaacagcgtgcaccctgatgtggagagatgcagagtgtggtccaataataatattgaccatatgcttttctaaggcaagcagacatacagtagatactttaattttggtcgttggggtatggaaggaggtgggaagtggagaaaggagagtaacccattacctgtctggcctaagcttgttatgatctgacagatgggtagccccagggctgcttgcaaaaactatttctttttgtctccatcacagagccctggggtgtggtacagggagggttgaccaagagaggggaggcttccctgatggagtgtgaggtctggcagcaggacctgacaaaagtgagtagactgtctgggtccagccagctataaaaggaaagaacagaataacagctacagctcggtgggagttctagtacctggattttcacccaggtggatgccaggcctgattgtctatctcctgaggaatttccagactttgtcagagttcttcaggaactgaccagatccagtttgcaggttgggggtcatcactatttccattgggtcaaattggagtaagcagataccaagagtcacttacaaatcactaacatctattagatactgaccattctctcattttctcacatcaaccatgtgagataggtattattattgttcctgttttatagatgcagaatctgtgatttgtctggaaccacagctataagtggtgcagcttggatttgatctcacatttgattttccctgtgatccctgggatctggcttaggtttggatatgcctctgaacaaatggtaaacaagggaacctaaatgtccataggtgtctatttacctggttgtccttagttcagcatctttaaaatacaaaaatagatttgttgagaatactcatttccattattttaatgagaataacaactcagctaacttttaacatgaatatacactaaaaccaaaagtattatgctgatggcaatctctacttccttcttattaaagcttatgagccatggaggaccctgcccagcctgagctgcccaatgtgcctgcgttagccagcctcagtgtgtccctttgtaaagcgccccagaccttttgagtagggatgaccacttcttaattcatggtatttatcagtaatcatgcatatgcaaaattttcaacttctgcttagagcctttactaatttatttctgtgaatgctctgattccttccaaatgactctgtaagatgatggttgcaggcttcattagttcaaccttcagaatcactcaatgttacagtcccagttttctctctcttttacccaaataggctttacctatattaatgattgttgctgggctcttcgacaagatatttcaagaatgggaaaagcgttttaaaagaagtttcatgaggctttggaattcacaagctgtgagcagcactggcagatatttttccagggtgttcatttttattcatttccttatagcttttatggctaaccgttctaagacatatacagtgctgtgttgtgatcaaattttctcctctgatagaagtcaaactttgaaaacttagattcctagaattgttgaacattctaatcaaaaacttctttgagtcaatccagtttaaaatatcactgattgcgggggggtggctcacacttgcaatcccagcactttgggaggccgaggtgggaggactgcttgagcccaggagttcaagaccagcctgggcaacatagcaagaccccatttctaaaacaaacaagcaaataataataaaatatcactcatattttagttctttctaacccatggttgatactctcaaccacagagtgaggaacttactttctgcctaccatttaatctttgatctctaaaggtttggaccaaatggcttttttgccgtaagcttaaatatcttgtcttatttttttttcctacctatttgtccaggttgttttctttgcatttaggacagtggttctccatacgtgtgcatcaaaatcacctggagtataaaatacagattcctggggctggctgtggaatctctgatttggcagggtttagggagaggcctgaaactgcatttttaacatgttcctgggtcgtattgatgatactgattctcaccttgggaatcactgacctaggaaatgtcttctcttcatccaaagaaacccttacaatccccaaagatgcctttttttctcctggctgaacaaccccaatttctatgactttcctttttagacttcagcttctccaccatctcaccatccacacttcttgcttgcctgtcctgcttgcctatcactcactgaatttcagggagccaaactggcaatataaatgagtgaaccaccacaggtgggggtgagatgagtcagatagggaagacagcagagactgtctacccggaatcaactgaggaatgcagacctcacccaaacaattcacattcctgtttttttgtttttgtttttgtttttgttttttttttaagcatcaagcctacctaataaaatatgaattataaaaaataattcagttgcctagatttgaccccaatgaatgatagtttgaggtcttaaaatataattaaaatgcagcttgaacctgaaagtggcagactatcaagttattatccccagttgtttgggtttctattacatgaatccagttataaaaataacacttaatacattataaattcctaattagggagctacccagtaactgattatattgacaaagtcatgccataaataagaattaaaaagttaatataattgattagctaggatgccctcactcttgtttttgccattatttaaaatttaattgctttgcaacatttccagatgttgattttggacattttttcatgtgttttattgcctgtgagcagtttttatgtacttgtaatcggagcttttcacgtttcttggatgtagaaaaatcaattaaaatgaagcaaatatttttgaaacctaaccagacttttgtctttgttttctcataaagttcctccatagaaatgtgtggcatgggaacagagcctaatactttctgaataagatattaacaggcttgtagtggatgctgggaatttagaaagctctgttttttttttttttctaaagcctcccagtagaatgtcagactaataaatggactgcatatttccacagtgtttttatgacatgtttcacacactgtcttggtgcagatatgagaaagcccttgtccacagcccagttctgactcactcattaattttaccttgtattcagttttcttggggtggatctagactagaatagaatagaataagccgacctttaactacagtccttaaatgaggaaatctccaccctgggccagctgtgccaggaatcccgacgagatggaactccgctgtggtttataggcagggctgattttcaggggggagtgcacccatctggactccctgctgttcccatcaatctattccagccctggtacccctggaccaccctactgtccagcaactaaaggattaacaggagccacctccaggagcctccgggacccttcagaaggtgtctgatttgatggatcagaggctaggccactgccagctctctgcacatattttacatatcacccatttgcaggtgttgaagaccggtaagtgcccaggagctggcaggtgttgcaaacatgtcagtgtacctggtgggggcgctcctgcccagctgataggagacagcttctacccagcccacccctttggtggctacaccagcttggcacagtctctcattgctgaagagcatccccccgccaactccgcccaatccccacctccagtcttgactacttttcattggtttgtttgtttaaattgacatctcctgattttcaaaaccttgctgattaacaaagcaaaaagagcacacacaaaaaaaaaaaaaaaaaaaaaaaagtcaaaaacaaagcaaaaaactctcagtctaaaacagataaacaaaccaacaaacaaagcccaggggctgctagaggttgactcttgtaaactgcaagaacggacaccacaaactccagagcagagggcgcctggacattccagtgacttcatcaagcagtaaaatatccgtctttcatctgcttctgctgatgaccaatactatgcctgtcacaatttccagtcttttagagctactctttgattacacacaaccgagactttttctaagcctaggacattttctgtgtccttttaaacattgtttacatcaaaataatgatatggataggtaaaagaaaaatacaaaactacttgtgctgtaaagtagttctattttagaaaaggaaatcttgacaaaacttgagccttgttaggaaaaaagaaaaatgacaaagcagtcatgtacagaaagcctggataggattttcaatctccttgtgcaaaatctggcaaaaatgtatgctaagggtccaaagcaggaagtgctcagaaagcaaatacagaaactcagcttagcaaaggggcgaagccagagagggatataaaggaacagaggaacggctgaggatagaggtgaggaagctggactcacacagactgggtcttgctcagccttctgcagtaccagtgtcagggccaggcacacaggagtgactaggagtttgaactgaaataatgcatgactaagaattaatttgggatggtcttcaggtggaatgattggaaatgttgttttacttttaatttttcagtacatgaaagaaaagatgcctgttttctaatcattgaaatcttattatgtacagaaattttcctagcagagcacacgaggatgaaaaagaatcagatgggagatgaggatcaggactctttctgtgaatcggaacctctctgctctgctccttttctggtttcctctgtctgtccttctcttgtctccattattcatcctgtttctgccttgatgtcatcttgttggatgtcccatctcacttagtcgtctgtaatttgtaagtagcatttaaattatttgtggtctttatctaataaagctttattctctctggtcttgatgaatgaagaaggcaaactgagccttgttttttcccttattgtcttacttccccaaagcacctgaatgagttctgtgtggtctttattgacctgtgatgatcactgtcccataaaaaaagcatggtagcgtagtgcttcagcataggctctgctcagaagacttggatcccaatccttactcacttgtcgagggagtttgaacaaataagtgaatttctattgacctcactctttcacatatgtataaggggaattgtaatagtacatgtttttttaggtcattaagaggattaaatagatagaatataaaatacgttagcataagtgcctgggacagggagaatactcagctaagttggaaatcaggtgttggcaaactttttctgtaaaaggcaagaaactaaatattttaggctttgtgagtcaaagtctctgtcttaactccttaactctgccattgtaccgtgaaagcagccacagacatatgtaaatgagtgagtgtgggtctgttccagttaaaccgtatttacaaaaagggacagcaaataagatttggctcatgtctctcagtttggcgatcctattgtagaatatagttttgacatactggaaacagcttctctgtaagttaggatctgctttgttgctaactaatttaatgtgaaatttaattgacctatccatatgctacatctgacaaatagtttggcacacaatttgcttagcctttgtatctcgaggaccagagaagttaagtacgtttggccaaaagtcacccagcaaattgatgacagatctggggcagagttcagggctcgtgttctcagttctgaactatttctttttttttgaaatgtgtgttatcggggacgtagctctgtgatatcaagagactgggactgaagatctagttttgccagttgcggaacctcagatttgtaccactcactatatttggacctcagctccctcattgtcaaatagataataattcccatctcacaattttacagtgtgaaaacaagaaaatgccatatatggaaaatgccatatatttgaaatctctattgctgtggttggccagcttccttcctgccttccttcttctccttctccttcttcttcccccaccctcccctctctctctctttttctttctctttctctttttctttctttctttcttttctttctttttcttttctttctttttcttccttttctttcttctttctcctttttcttttattacttaattaacaaataataattgcatgtattaatggggtacaatgtgatactttgatacacacacgcgcacacacacattgtagaaagattaaaccaatttagttaacatttatcaccttatctacttataattattttggggatgagaacttttaaaatctactcttttagcaattttagctatgtaatatatttttatcagctatggtcaccatgctatgttacaacttattcctactgtttagctgaaactttttaccttttggtcaacattgcacctttccccattctccctatcaacctctgataaacaccactgtactctctgcttctatgagtttgacttttttagattctacatgtaagtgaaatcatacagtatttgtctctgtacttagtttattttacttaacataatgtctttcagtttcatccatgttgtcacaaatgacagaatttcttttttgtgtaaggctatatagtattccattgtgtgtgtgtgtgtgtgtgtgtgtgtgtgttttctttatcctttgatcatttggtgggcaattacattgcttttataccttggctaatgtgtataatgctgaaatgaattatgagtgcaggtatctctttgacttacttattttaattcctttgggcatatactccgtagatggattgctggatcatatgataattctgtgtaatttggggcgggggaaccactacactgttttccatagtggctacactaatttacatttctatcaacagtgtacaagggttcccttttctctgcctccttgccatcacttattatctttcgtacttttgatattagctatcctacaggtatgaggtaatatctcatgttggttttaatttgtatttccctgacaattagagatggtgaacttttttttcatatatctgttggccatttgtatgtcttcttttaataaatatctattcaggatctttattcactttttgatttggttatttcttttttttaacattcagttgtttgagttccttatatatgatggatattagccccttatcagatgtatggtttgcctatattttctcccaatcaggagggtgtctcttcactcacttcgttcttaattgttttctttgctatgcaaaaagtttttagtttggtgcaatcccatttgtctgtttttgcttttgttgcctatgcttttggggtcctatccaagaaatcgttgcccacaccaatgttgtgaagctttttctctacattttcttctagtcattttaaatttcaggccttatatttaagtctttaattcactttgagttgatttttgtgtatggtataagacaagggtacaatttcattcctctgcatatggatatccagttttgtcagcaccatttattgaagagactgtgctttccccattgtatattcttggcacctttgtcaaaaatcaattgactataaatgtgtgggtttatttcagggctctctgttctgttccattggattatatttctctttttatgccagtaccatgatgtgtgtgctattatagctttgtaatatattttgaaatcaggagtgtaatgctgttttgctttttttgctcaagattgctttggctatttggggttttttttttgtttcatataaattttagaattgttttgtctatttctgtgaaaaatgccattggaattttgatagagattgcattgaatctgtagattgctttgggtagtttggacatgtaaatgatattaattcttctaatccataagcacgggatttctttctgtttgtacatgttgcctttaatttattttatcaattttttttggttttcacttcctcaattaaatttattcataagttttctttttgaaatactattgtaaattggattgctttcttaatttcttgtttgtatagtttattgttagtgttataggaaatgtactgatttttgtatgttgattttgtaacctacaactttattgaattcttttatccattctaacaactttaggtgaacactttagggtttcttctatataagatcatcagcaaacggagacaatttcacttctcttttttatttcaatgctttttattgtctataaatttattgactgctctttaatctttcacctactttgtaagataaatttagtgaaacaggttagacagcatggaggactctgatacaaaacgattttataaaaacacacagatataaatgttttctgattaatggccattagctagtttcccaatcagagcacgttttcacctgtgctctttaaattgctttcaatgtagagttacaaaatggaaacttaagggtcagaaaaggtcaaattacattaatgacagtcctcatgatagtgttgatttaatcaggatgcctacctttgttcatttaccttttaaaaataagtataatatattgcagatcactaatactgctgttagagaaggtggttattgtattaatgggatatcagtaaccttctctctactgtgacatggattactgtaattatgaaagagacataaggaaacaccataagcactatccattgggccccaggcttcattagttctcatatggctgtgtaaaaatgctaattacaaacatatcgtaataaaaagggtatggcttaatgccaacatgtacctgctaatttgatatttatgatggtagagtgaagcacatataatcaaaagcaaagagacttcagtagagcagcattctgtattttgctgactgaagaaggctgtgagattatccagccatttatttaattaaaataatattgactggtgaccatgttattttatttagtagatgtgtaagcatattcatttaattttcaatatttatatttcatgtgattataaaaatgataaaagctcaatacataacaggtagtatggacatgtacagaaaacaaaggtagcagaatcctctaaactttagctgcttcctggtctacatttatatgcacctttctcactagaaaacatatcgattattttctgaattgtaattgttcaatttaaaaataattttaaataaggaaatgttggggaactgatatagctcagtgttgaggcagagatgttcctctgttcatatgttttggccatttttatgtgaagctgtagagaacagtgactagggtacttgtgctaacattgtcctccttattaaattggacatacatcatattttagggcaaaatttcactttctgatttctcagaaagcaaaagcgatatcaaaaagtatatcaatctacacttacatagattgattataacattttcatttattttttttttcacaaacactcattgtgttctgtctgtctttggaatgagatatacctgaatttcagtctcagctttgctccttaacaactggaaggtatgtccatgtaacatgatcccccaggcctcaacttcctcatccaaaatctatagattaaaatttgtcttctcaggtattgtgagccttttgtgagatcatctttatgaagttcctggcaagaacaggtactctgaaactgttagccagcataatgtcaatatcacctcctattattagtgccatggtattttgtgaagtgtcttattaacataaatatacatgggtaaacattttcacaaggatgtctgtaaaaaaaagaaatttctagtgaatttccagaattggaaaattgtggaatttatccttcatcagattttagctccaatggtgtctacctgccagagtgctttgaaggaagatccatggagtttaagataaagttagcttgttttacagtacctgttacttttataggtttttttacattttaatagctattaataatataggtatgattatcagcatgaagctcccatacaaataagtttatgttgaaagtgtcaatcgtcattaatatcccataagaagaaactatttaaaacttcataggagttcatacatggggttcccatggcaacaatggagcttataatttttaatttattgcttaattttctctaaactacattgtcattgcatcggcaggaatcccagtctgtagtaatgatggggattaaatggtcattatgaagttgttcaacattcttgtgatttgcttcagggaacattggctttgggtatctttgaatgtactattaagcattgttaaatccatttaaaatagactgagtttacagggaaatgaagtatattttcttattgcaatttatcatccagtaataatggtaaatattgcaagtcaaaatttaaggccaaatgtaactcaacagtgagctgactaatggctgtcttgtgcttaaagaaagtatattgcttttgcatttaaccaaatggtcattgaaaagtataaaaagatatttaatagctacaagtcatattccagaaggattcaatctgtaatataaaatgagccaaaggaatcggttgctgtcttgttaaagaagataatcattacctgagattttatttttcttataagtatctcctcctatgtcaaggtcaaactgatagcaggttagaggtttgtgtctatggacatctattttgcaaaatacagctattcataaactaatcctgaaatcatttaaaatattgcaggatcaattcaacatacctatacagtgtcaattcagggaggtcaggaaagtctgtaagggagaaatggaatattagctgggaagcatggggagaatccaaacagaagggaggcagggaataggcagaagaatgacagacatgaataccattggcagaatgtttgtggtgttattgtaagttaaaatgttaagggagaaggaggcatagaaatttgctttccaggtgggaaatttgatcaagagtctatcttttaggaaacagacaagatggaatatagatcttccagcttgtagtatgtttcaagtgttttaagaatacaacccaaacattatcaagtgatgttttaggcaaaggagaaagtaatgtgcatgatactgaatgttcctgtgagcatcaaggaacgtgattagcatcgggagccctgtgaaattgtctaggtcactcacatacctttgtgttcctttaggattattacaaaaaacactcctatcaaggtagtttagaaaacatgatctccatttaatagaaaggggatattttgtttttctagagtggtaactgaaccttgataaggaaaatatgcagaaatgagtgaaaaatggggccaagttgttgactacattgaataaaatgttagtcaacatcaaagtccttttatgaaggaaactgaattaacatgtcatttattcattgttacaaataattttcagttaaacaagtgaatattttctccaaaatggctctaaatttaattgtcatctaaatgtttgaatattttggcttttttagtctcctgtgaacatgtctgttggtctatggtgtctcacggtgtatgtgctcctgtgagcatgtctgtgtgtatgtctatgtctgtgtctccgtatgtgttgtatttgaaagtctaaaataggaggccctttaagagaagtgtttatgatgttaaaatctcaagtcttttcatggaagtgtgtctgcgcaggtaaattggatgtatatttctctctgaatgatctgactgttgggtttaataaggctatagctgatgccagttgtgttgaggagtttgcaaatttattgtcaaataaactctcctcttacactgttttgagatcattcctttgggcttatgtactttttcttcacatgtaagtaaaatgccacaaatgcttactcttgaaatcctgagagaagtggcatattatttttatgggaattgtacgattcttaaccactgtccttgattaaaataagagccttttttccttcttaaacctgatcattttcacactggaaatgaaatctttcatggggattagtttactcactcaagctttccattcagatgaaggtgtgaaaaatacatgacaagaatattatttaaatgctcaaacttctgcatgaagagcatgaaacaagaagaaaatgatagtctttagctgtagataggtttcaattttttttagtaggcttcaaattccttttaagacaaacaaaaaattaaaatagaagaccaactatgaaaataatgatttgatttaatctaaacttccatgaaggctgcaagttacagattaggtgcatcacctgaaagtaacattgctgattgcatagctttggaagctaggttcaatgatgtatatgcaagtaactaagtttcatatgcaatggttctctattgcactcaggaaattagcctggcatttaaagccattcatcatccaacctcctgaccactccaacactatcttccttcactctctcagcactccaaatatctctaactgcttgcagtttcctgaatatattactggttttcaagtctctaaaaatgttgctttccctgtctgtcatgttccttttctgttgttccatctattggactcatcctttaggatttcattccggaatcagtttccttctccaacatcttcctttgggttacctgggtggctaacgccctctgttctctcatagtaccctgggttcactccagtcatagttctttatacagaatattttaagcatgtttatttttctgcttctcttattaagtagagagaatctaagaaatagaaaccatgccttcgttagttttttagtcccatagcatcaggcttcatccctggaacatagtaggtgctcagtcaactttgttgagatagactttgtgagatgcagcagaatcaaggaaggtaaatgtcctgggttctatacagagggagttaaaaatacaaataagaagaagtcactcttctaaaggaacttgaaaaggaaaagatgcataattatcttaaatataaagctatgtgtggatgctgtcagatgttcacctggaaagagtcctggaatgaatggagcaaaaaattcaaatttcttttcactgagaggtggtggaaagccttcatgaataaagaaacatcttgagctgagcctcaaggatcctataagagttgtttattgtttgtttgtttgttttagtggatatttactgagctcacatagcctgtaagaatttaagctctgtattaccactatggttgacaagtgtgaatttaattagcccttttcaaaaaaataataaaaagcaatccattttacctacctaaacacaatagaatcatctaaatatcttattttcagtggttttctgatagaagataatgcacttattctgaagtcctgtcccctagcaacactcttcttcaccagtctgctaatggcttggcagaagaggtaaactcagttttggggcaaaagttttttaagcaggaaatcatgcaaaagtataaacagcaaacagattttaaattctgaaggttcctgggaaaagtcataggatactgaatgctttgtcatggctatacagatgaaaacatcgctaaacagagtgaatcataataatggattttgtaaggaatttctttttttttgttttgttttgttttgtttttgagacagagtcttgctctgttgcccaggctagagtgcagtggtgcaatggaatttttaaggcatagttctctgtttgcttttaacccaagcaagaagaagaaataggactgtaagagagacaagaaccctatcaatttgaataactcagggaatagcaaagtatttgactttgaatgcaggatttctctaaaacattgaatattgaagagaatattttaaggataaagaccaacattcagttagttcttgctcagtaaatgtggtagtagggaaacaagttcagcatgtgatctaagtactggcacatgaatgaacagcaaggctcataaacagccaatgagaaaatgaagctcactgttaatatgggaaatataaactagaataaaattatattggaaaaattttaaaaatatgtacaatacctggagccctgggggtatggaaaatgtgtactataatacactgttagcgaggttagacgttggtgaagtctttctgtcttgagacaaagtgaattggcatgctatttcctgagagaggaagactgggaaagaacaaggtatagggaagtattaaaaaactaagaattctatttgggaaattttaaaagattattatcaagaattcaggtggggatgtcaaataagccattgagcctggagccccaggaagtggttagtgctggaagaattggagtcaccggcatagagaaagtacatgaagttatgggactttagttatcaatcactagtttcataactagaggttggttaatggtctgctattgcagggtgcactgttctcagaatttgtgtggatatgataacacaagtcctgagttccaactttaaggagcatgaaatcttgttttaaatacagaagcaccgactatggggcaagtggtccattaaatatataaagcaatcacttcccctttttttgtacctttagtaggccagcactttgcatacattggctataatcttcacatagacatgccgaggtagatattttttccccagttttactgataagaaatctcaggctctgaaaggataagtgaattttatattaatacattcactggatagtaaatggagttgctggatttccagtcctggtctatctcattgaaagcctgttctcttttcaactgcctttcagtaacaggtgctgttgtcactgaatccttagcttcctgacccatactatctgaataatgatccctacatacttctaggaaagaaagatatcaactgcaattacccctatttgacagatggagatcctggattgctctaagtttaagcaaagcaattaagcttggccaaggtgtctgccatgggaaagcagattcactccattgcttcttagattcaaatactgcaatgtattgattattgcatgaatatattcagtggcttgatataacaaagtggcccatcactcttgatcattctcaatatcagtgtgcccaaaccctcaaatgacttgccggaagcttatatattaagggaaacttccagaatgcaatggaaaatgaaactttgtttcactagaatagattctgttcttgaagagagaataggacaatagatttggttttcatggatcaattctcattcttcaaaacttctgcaattatctgtcgaatttaaatttagctcaagtgaacactagtttccaggatgggttcaggagctcaaacttgatagctaaaggagaggtgaatggctaaaatacctccattcttgtgagcttaaatttatacataaaagtgtcaaatcactccacaaaatcactgagctttcctttttattttactttttacatttaattgctgggcagttgaacattacagggcaggctactgcatcagtactaggtgccttgctctgccatcattttgtcagttgttctgtgtgtcaaatatattattctgtttgcaaaagtcagccactgacttttaacattgtcatcatctcattctattccccactcctttttgggcagagtaaatctttctaaagacaagggcaagagaagtcactaagttattggctgccctttttcactgaacccaaagagaatacattgaagtgtcaagtgagtgagcttccaccgcttctcagcctatcatcattactggcagagaaaccagtaagtcaacccaagacagcaacggagatatgtaactatgggatgtgttgctttcaagagaattgcaactcagagctctttctagcacgtggaatcaatttaacccttttatacataagccaaagtcctcccttcatgactcagttatttgagttaataaagctctccaaatctgtctagtcctttagctaaacagtgttaactaaaccatgtgaatctcctcctctaattaacagctactttattaaaatgctattgccctgttgggaactagttggcagggtgacagagaatggagtttgtgctatggactattgattttcagttaaattcttactgtgctcttggctttctcctgcttgtggcttaaagtacccaaaccattcaggccagcaaaagaggccactttgctctccctggtttttattggcctcttttcagaaggtctaattaacctatggagtcttccaaatttaccgacagctctttcatattaatctctcttctaatataagaaatttcttttttaaccttccactcaaaaagattatttcaaaaagtgcccacaactgaaggagtgacttaatcaggttctcaaggaaaatgcctctctttactttgcaccttaagctctgccattgttattttatgttttgtgcatatatgaacttttcattcctgtctttaaaatatttatcagtcatataaaatttggataatggtgagaagcacaaagaaggagataaaaatcagcaaccagataccaactacaatattgtaaatatttaggcaatatagtccttgaggacttagattttcgattagacatcactgtcattcattacatcagtaggtgaatgagacaaattaattcaggaagctataaatgatgggaaatctctggtatgtcaatgtaggataggtgaaggctggcaagagagttctggtttagaagtggttagaaaagatctctgtgaaggctgaggaggagcaatctaggcaatgcctccaggtaggaacatggttgtcctgattgaggctaggacctttagagtcatggacaaggtaggccgtggttgatcttaggttagtaatgcaggagaagacagttcatgtatgcttttggtactatggtgaggaattcagattttattttcagtgtggtgagatgccattattgggcttcaagcaagggacctatatgatagggtctataggtttttgtttctctcttaaaattttttttttttttttgagatggagtctcgctctgttgcccaggttggagtggagtggtgcaatctagtctcactgcaacctccacctcctgggttcaagtgattctcctgcctcggcctcctgagtagctgagactacaggcatgcaccaccatgtctggctaatttttgcatttttattagagatggtgtttcaccatgttgaccaggctggtctcgaactcctaacagggatccacctgtgtaggcctcccaatgtgctgggattacaggcgtgagccacagcacctggcaaaattttttaattggtacataatatttgtacataattatggagtagatgtcatattttgttacatgcatagaatgtgtaatgatcaactcaggatatttaggatattcatcacctggagtatttatcatttctgtgtgttggaagatttcaagtcctctcttcttgctatttacaaatgtacaatatattgttgctaactctagtcaccttattctgctatgtaacattagaactccttccatctaactctacatttgtactcattaaccaacccctctttatcactctcactcgaaccactgccctttacacacacacaccctccccagcctctggtatgtatcattttactctctacctccatgaataactctggctgctgtatggagaatggattttagagagcaagagtgcaagtagcaggggggagatttggagtcaagagatggcagtacttggctgaaggttggtagtgagaggtaagaaaagaaaacagtcaagaaaaatgatatttttgcttattcatattaggaaaactaggtggggagctagtttggggaaggaaagcaaataagagttctggttttggacatgtgaactttcaacttggttatagtagtgtggaattcaagggagaagttaggattcaagatataaatcaactagtaaaggagaagttataggagttattatagtatttagccttctaatctttttcatggtttgatttaatatttttagaaaagactggcactctaatatctgtttatgccctatataacttatttattaaaacatggtatgtgcatttatatatctatgtatagatagacataaaaaatattttcatgtatatttttatataagtactatattgcattccattgtatggatgctaccatttgctaatcagttctctacaactggacatttatgctgttatattttattaatttataaatgtggtagcttttcaataaatcttgacaaatattcagttttttttctagaacaaattttcaatgagaagtagtactgggagaaattttaagaatttttatataaaaatacgatttgcattccatatcagacacctaatgatggatgctcaataattatttatttgcagactgattacagtctcattaggattacataaaggtgacattttctcttggctttggcaaaaccgaatagtgcaatttataataatgtcaattttgtaggcaaaatagcttatttattttacatatgtaaaattagggaaatgttaatatttttcatacttttcattaggcatttgttcttttgtaaacattcactcatagttgtttcctgcttttgaataggtgatcatttttttcctcattgtaaaaactctaaatacatatagaatatttaaatttttatcataaatatattacatacttgttttctttcatatttgttatttacttcttaattgcatttgtgagtttcttttttttgagagggggcgtgacagaggaatgtacaggagactttagtattttatgttgctaaagtagacttttaaaatattctaaaggaaaataagccttggaaatctaagaattattttttgtgaattgaaaaaattctcaatattccaacagactcaaataaatagctgagtaaagctaagtacatctagtcaacattttaaaatcatcttcccatttgttttcttgctattcattttttatttgtcccatctgttctttgttctcttttcctgttttctactttttttagattaattgaattttttatttttatttttaatttattattaattttttttgtgatggagtttcactcttgttgcccagactggagtgcaacagcgcgatctcagctcaccacaacctccgcctcccaggttcaagcaattctcctgcctcagcctccccagtagctgggattacaggcatgcaccaccacgcccggctaattttgtatttttagtagagatagggtttctccatgttgaggctggtctctaactcctgacctcaggtgatccgcccgccttggcctcccaaagtgctgggattacaggcatgagccaccaggtccggcctgattgaattttttaatgattccatattatgttctttgttgacctattagctataaatctctgctttgtattttagtagctgttttaggatttttcatatatctctttaactattaaaatctatatttgtgatattataatacttcatgtgtaggaaaattgccttacaataagttttttcattttgcctctcctggtctttgtggtattgttacatatatttcacttttgcccatattataaatactatattgcattgctattatttttgtttaagcaatcaataattgtttaaggatatttaaataattatgtctatatatacacacatatatatgtatatatagaaaaatatatatatttactaatttagttaccatttctggtgctcttcattcttttgtttagatcaatataatcatctggtattattttccttctgcctggaggacttgctttaacatttcaagtagtgtgggtctgctgctgacgaattcatacaaattttgtaagtctgaaacagtctttatttatcttcattactgaaaggtatttttttctcagtagtttttttttattccctccttggtattttaaagatgtgcttgactgtcttcttgctcgcattattttgataagaaatctgccatctttcttatctttgttcctatgtatgtaacgcatcttttctctctgcctgtttgtaagattttctttttatcacagatttttaaaaatttgattatgatgcacctttatatagttttattctttttaaattattttttcaaatgtggcttctatttcaactgattgaattttttcttcctcattggtcttatttttctgctttttttgcatgcctagtaattttttattcaatgtcagacattgcaaattttacttgttgggagattttattattattcataaaatttttagttttattctggcatgcaattaatttacttggtaagtgtttcattctgttagttcctgtttttatgattcgtaggctggactaaggcagtattcagtctagaacttattatttccctctccttatatatgactctctcaatagtaaacaaaatgattcttaagtctgaatatgacttagtggcagtggcatccaaaggggcagggtgatgggagtgttccaccctgtagagaattttataataattgctgtgtttactgtaaaattttataaaatatgtataagcttcatattagcacattattattacttattatattttttatatgaaggttaattcagagaactcccaatttcataattatctcctagcacacatgggctcagccacagttatttgttttcagaataagttcttttgggtttatcattgtttaaacttgtgataagcgtttgttgtacttttgtaaatatttgcttatatttaccaccttctttttaatacgtgattgtttttgtttttctcattttaaaaactccaaatacataaagattattgaatggtgtgtttatcataaatatatttcacacttgttttcttttatgtttgttatttacctattaattgtattaatgggattcttcatttttttgaagggggaaagcgtgagagggatgtacagaagagtttcttcttttatattgctaaagtagcccatcttaagattttttaaaggaaaaaaaaacccttggaaaactaagaattatgttttggaaattgaatatttgtcaatattattcctcctccttagacatgactctcttaataataaacaaaatgactattaatttaactctgaatatgactttgaatattttctctttgtgcagcctaagattgctgcatttgtcttctttctatggtagtacctgttttcatgtaggatcgttcccctaaatgtttgtcaacatttggctgtctgcttatattaaaaatgctgtgcttgaaacctattccaaggctctccgtgggtaggtggctgggaattgtccatttggcttctctcttggaagatcccagtaggaaaccctcaacatcagtatcttcaggtcatattctttggagtggtcagagtccccagagaaagaaaacattcctccactcttctacagatgtgaaatacacttgcccatcaaaatatggagagatagatgaggaaagaataatgaaagtatcaatacataatctcgagttttgagctttttcttttctcacaatgttacaacctcatccaaccagactacctagaatagtgatcatggttgacatgtgcagtcctcacctgtgaatgatatacctcagtcctggggatttctgatttaccctttgcagggaattaccctcccatctgtttccatagtggtgcaaggtaattaacccagcagtgtggagtggcctaatgtgagagaaagttctgtttgtttcttaaccagattcacagaagttctccatttttaaaattgtgctttctacatcccaattttagaggtatcatttctgccattttctcagattttggaatttttagaatctaaattgagtttccatcaatttttctgacttctagataaactgttcacctttctctggcctgctgagtcagttacattattctctgctttctagcatccaaaaggtgttttgttgattcttataccctttgttctttttaattcatgccttcctacaattcctttactagagatttattgcagtttcatgatgaagttgacctcagtactgtattcagcttaccatcttaatactcacatatctgcaaacatctttccatagcaattatgtgaagaaagcgacgagcatatgtgtaaaattttatttcagcttcatattggtatctttatgcacacctgtgtagttcttttattcttataattctaaaatgttggctagatgtacttaggtttgtatagtcatttgttttgaatgttaagaattttcaatttacaaaaatactctttttcaagagtggctatcttttaggatatcttaatcattttttttcccactttttaaagatctggtattttcttaaggaacaattatctatatttcagaattctatactcatccttctttatatattattagtttttgtaactttgtatcttttgtttttcacttcccttctgaattctaaaaatgttcttgtgttttaatttttttaattttttatttttttattatactttgagttttagggtatattacttacatctctgtaaaatgaattttgcttaatactacttccagtgtaaattttgattctacaatttgatttgtactcttccttaaaatatttctttatttcacctatctttcttataatttcactcattttgttttgcatttctacttgctctctctgtaatatttttcctgttttcttaatattcatttatttttattctctattaaagattatgtgtagtttcttctaagtttttctgatctttcagtatatcatttttattattctgttttttctgagtctattgatttttctttatattgttttccaacatttcttatttttttctttattcacctttaaatgaggtaggattttggttgatatttgttctactgttagcctacttgtgtgtaaacaaattagcttctcagataagatttcaagacttaagtttttcatgtgtgtttttttttttttgatagaccactgatctatggatatgagatattttctatctccactgttttgttctttaattctctgaactgctgtagtgcattaacaaatgttagtttctggttcacttttctatatccaaattctatactcaacacattaccagagataacttcacaacagaatagaccattctaatggagtcccatctgttcctggcctatgggtttctgaaatataccaccttttctcttgtgcagaaaaatggcatgggtgagaaaaggtctaacataatgttcagctcacagagtactactgtccaaaagacagagagagcaagcatgtggccgggtcttcagattagtagttacttgacttctgagtcaataaacagtaagtaggtaatattaaaatcatagcccaacatttttcaggcagtacctctgtattcccttgaacttaatatgcgtcttgtccaaacctgggtatttattttctccatgaaaatccatatggttcaccattcaacacctgattctgagtctcagctttttcatttattagttgtttgaccttgggcgaagtctcactaaagcttaattttctcatttttaaaatggggaataattgtgagaattgaatgagatgatgtttataaaacttgtggtatatatatatatatatatatatatatatatatatatatatatgtaaatatatataggtatataataagcatcattaaatgttaatggccatcattacaaatagagtcagctttttcaaaattgccattcgattgccagccttcagttttgatagtattgtgagtttccatatttttctttttctcacccccaattgatattccaatcagaaggtaggagaagtcatattataagttaatattgtttcaatccaaaatctctttaattttaacatttctatgttaatttgatttatgggtgttgtcagattgttttatgcagtctgagatcatttgtcttcatgtgaaggagctgaagacattaatattgattatgataatagatactctggctttattagtgtcattattttctattttctttcattttcttttcctcccatttttgtttaattctcatttagtctcctggtgcaattcaatcaatgtatttggtatgaagtatttcaaaaatagaagtcccatttttgcataaattaaaataatgtggaaagtagagacgcatcaaatcaatcattctttctcccctagttgcctggcccagtgatgtactaaaagatgaagtatactccttactagcaaggtttttcctctctttgcccagcagccctaccttacttcccaccaacatgtcctccgagccacaccttccaggatttaaagcactgcttctactttgccagcaccaaagaaaatctgtgtagagaattcttggcttagttgctctctgatagatgctgtatagaatgatataggtcataaatgggagtatgatggaaggggaagcagttatcttgcagccactaaggacctggaagcaagatgtttccttcatcagagcaggttaaattcagctgcgagtattacagttcaagttagtggcttaagcaaaatagaactacatatttcttccatgtaggagtagttcagaggtaggcaattcaagaattcatggttccaggaactcaaaaacttgctcttgtttctcatgcctggctgcttacataaccaaaattgcttcatgattcaaaataactgttgatattctggccactgcatccacgtttcatgtagcaggaaaggtaaagagggaagaacaaggatatcccttccttttaagagaatcttaagaagtgtcatgacaacactgcttcctatatcttataagatcttagtagccacacctggttgtaagaggtgataaggaatgacatttttatcactcagcaatgtgcacagctaaaataccaggattcatttacatcagaataaaggtaaatggaatttgggctaattattgcactgtgacacatctgttctgtgtttggggttgatgaaaatgccccgtatcacatcagtagcagccagtgatggaaataccaagtgtgctctgaacacctgcatggggtttctattgaggaagtgagactcaagcttactgtttcctgctgcactccattggaattaaaattggtgaacagatttctatgattcctgcgctcattgctctttttatcctattagtggacaactaataaacaaagagaatttaaagtcaagtctactgaagtggccaaccgtgttgtctaaaaggctaagaatgtgaatgttttctgacaggtacattacagcagttttcattttaaaatttatacccaagaatatgtgggttactgcttgtctttgatttatttttaatgtggacaatgaaccccaaacatgaagaagatggtttggcgaaatgtttgtaacatatgtcctttgggaagtggcttcataaactggagaatagaacaagaaatctacgcttaaatctcagcttcaagacttcaggatcccaagtggtgatcctggggctactgctaaaattcactgagattcagcttgattatatatgaaaacagagatcaccttcaatctcatcagccacagaacctgtcacactgtgtgcatctctatctccatgcctggggtcatgcctttatgcatgtaaatttaatggtctcctcattctaacttcctataagattgaaacacagaggtctgcggggcctttcccgcttgacccataatgtaatgtaaagacccatcctaacactggccttgtgatgggccctccctgtctcccttcttttacatcattcccaacaaaagcaacccatcatagttattttactaatagttgagtaaaaaatgtaaaattacctctctctctattacttttagaatgtataaaaatcaacagggagtcttcaccacaggctcctaatatgaaagtgtctgtgcaggaaaatccataagctagggtgacttttgagttaaattaaattttatggctcaaaaaatgctttgcttggttttcactaccattataaagcaaagaggataatttcagattcagtttctacaaaggattgctttgggttgatacaggctttatgttagtggcatggaagtatttgcatctgcacattgatatgtagtgaaataggctgtaaaagataagatcaatttcctgttaaaggtaaaaaggccaatgtagccagatacattaagttttttttttttccatttgtcattcaggactgtttgacagttttacattagctgtgaaaggcaccaactggtacactactgtcaagacttagaaagtaggcacacgtacacaaacacgcacacatgctgatgtaaaatataaatataaacagatagaagcctggaccatacatatgagtgccaaaaatgcagttgtcacatgcatacacacctattaaaacatagcaacacaatcttatagcaaagacatgcacacacaggtacaaggacattgaccagatgacacaatgacacagctgggattgacaattacaggtgagcaagcaagatgagggctaatgtccataggagccaagagacctagagaccctcatgtaaacacacagagatgtatgcatatgtgaacacacacacacacacacacacacacacacgcatgaaaagagagacccagagacaaggccagacaagaacacaaagatcaacacttacgtacacataactaaaaggcatgctccaaagtgtgctagagactcagaaacatagaccctcactcattcatgtagccacggcctcctgacctctggttagctatgttttcattttgtactgagacctttaaagtaatttatttgcttcaagactcttcattgactcctccttcgtccgttatatttggtctactttgaagtgtaattcatttcaaattatgtttttaggtttaattcctacaattcaggttctcatgcatcatctggactattacagtggctaccggaaattacctggagtccgtctagccctccccaagtcattcaaaattacccatgtgtggtacatcattactgggtagaagaactgcttctaaaaccaaaaaataacatagagttcattgagtccattttatatgtaaaattttgaaagactagtagtcccattattgcacacacatcaattccaaattgttcttttcaaccttgagtaatttcaaggttgaaattaaccattctcctttatcttttatcctctatccctttacctttatctcccttcatacttacctctttccagccacttaaattttccttgtttcctctttatgcacatgtttttttcgtatctccataattttgcccatcattaagccaatctttcctcattctagcctcctttaataatgctaatatgaatagttgcctggcccttcgctctgacaattacatcctatttcttctgtttgttttaagtttagaaatcccacctgtattcaagatctcattcatttatatttcaagccttaattagtaggctgtatcctcttgtagctataagtagcacagagcttagtactgtacttaatttttctttcagtccttttcaatatatcagttctccccaaatgaaatacagtcttccagaagacaggatctccactttcttcttatccttggcattttccaacccctggctcactctgttatgattttgagcactccacatcctcatactggggcatctagttcctgctgcttaaacttctgactcccaatgctgtatcctcaatcccagttagaattccaaactccagatctctacttcccattttctaatgattgaagcctatttaagccccatggattaatttcaatttacaaattcctgaaacagtacaaccctttcccattatcttactctaaattgatttttccctctcttttttaaaaaaattatggttaattgtcctaccatacatccagtcatccaagttagaatctcaggcattaatttttaccttcttgtttcctttgtttcttccccaacattagggacattaagacctacccttatatggccttgctacccatcactttctgtcatcctctctgagtgctgctctgggccatcccctcaccaacacgaggtcaggcaagaggggatgattggcttcaagctgcttctttgcttgcaattttgcctcctgtgatcagcctctctgatgctaacagaatcatcattctgaaagacaaacctgatcttgtctttcttattgaaaaaaaactttaaaggctcaagagtgccctcaaataaagtccaacctcctttagcagcagcgccttttacagcatcaccttgacctaccatctcagctcaaccatcccttcccttccatttgcatccagactatactttcctctaaatgctgaatacatcatgtctgtgatcattgtttaccaatttccctttatccaaatgcttcatttactgttctacctgggaaactatgctagattttcaagactcagttctgaaggcatccacaatttgctctgggaaaattaaacatttccataacatgttctacaaacttgtaagatagcactcattatgtggttagctgttcacatatctttctccctaattggactgtaagtccttagagaatagatcctatatcttatccatcattgtctgcccagtatgatgtcaggtaatctgtgcatagaattattggctaagttgctcatgccaaaaaatacatactttggtagacggatactatttattgcctacctaatataaattctctagttgatatatatcatttcatttgatttctacagtaactccatgatatagttgcaattgttcctgttttcctagtgagatatctgtggtctagagaaaataagaatttgaccaggttagtctgtttacttttcttttagcccatcatactctttccgtcagcagaattgaaaacgtgttcataagacattacccttgcatccaacttaggaagctctggaataaacaacaggagcaagtttcttcttgtagtagttctcaaagtctttaatacattaatatgaatcttcaagtttgtctatactgcacagtacttcccagatctattggctttagaagccattttatgagattctcatgcaggatatcctttgggaaatgtaaccttatatgaaaatgctgtctttaaataacttctggtgttcttagtctttaggagagaactcctctttcccaactctttctcaggagcatatacacatccctacccaagtgcttcttcagtgatactaatttctgactgaagtgattggcacatcacatcctggaatcctggagacctcctcctgttatatgcctctttttgctctcagcagagaggagagagatagaaatgcatgcttgctgctccctatatgtttctatccatgcccaaacacgtaggctaccctctgtcacagagcacactgaaggggagagaatgcttggattgagctgattgaactccttggttgtctcccatctccagcggtgtttggtttgggttgaatgctgtagagttgcctgtaccttctgcactctacaggagaagctgatttatttttatctctgtctgagaacaacaacatggcatcccctgatccccctggtaatttcctgggctcaatgattgctgttttccttgacctgtttcacagctggtggcactgctactgacctggatttgttttccttagctcaaatgacatagtagcccaggagatgcatggatttgacaacacaaagcctcgatttttaaaacaagacacacacacacacacacacacacaaacacacacacacactcggagggtttttggagtcagagagaacatcagttccacccctagctccaagactccaaatttcaggtctgctgcttgccaattaggacaagttactcaacatcgtagcctaccctttccttacctgcgtaataatgataatattatctacctctccgggttgtgaagaggattaaataagataccttagtgccttgaagatagcagcagtcacttaatgtttgctatgtttatattactatcatttttcaatttagacttttattgtttccctttattacatttactgtatattttctttctcatgaactacctatctaggcctgattgtgtgttttttaatctaaggagaaactaaaagaaaaatctattgatcctttctacaaagggtttgtgattatctgaggaaattaatcataaacataggaaaaggttacctatgatatatgcaatattttaattatttttaaaagaaaaggttactttgtagataaactttttagataaatccattaacactcaagtttaatgtttacataataactgagtacaaagaccaagatttgaaaagaagttttttatgtgcgtattacttagagcataatccaactaaaccagtggaactaaaaactttcaagcctagaaagtttagattcttagaataattttttttgacatggtttttctttgtcatgaaggctagagtacactggagaaatcacagctcgctgccacttctacctcttgggcctatgtgatcctcccacctcagcctcacgggtagctgggaccacaggcgtgcgccaccacatccagctaatattttctatttttttgtagagacagaatcttgttattaaacatgaacaaatgggataaactaaaagaaagattaattcagtctaccaagactaaattagaaagaaattaaaaatcggaacagacctataaccagtaaggagaagaaaaaatattgccctggttgatctcaaactcctggcctcaagcagtcctcctgcctcagcctccaaaagtgctgggattataggtgtgaggcactgtgcccagcccatgtaaattatcgaagagcccaaagagcttttgcttatgtgggtcttacccatcaatattaatgatagtaaaattaatatgagaagacttttaaaatattttattggttaatgtagaaaataaaaataaaaccaatgtattataaatattctaatgaaaaataaattattttccaaaacgccctcacacataaaaatgagaaaaagggatgatgtacatgcatatgtttcattgtgattaaaaatgcataaaataaaatttccccttttaacaaaattataagtataaaagacagtattaactataagcacgatgaggtacagcagatctctagaagtttttcattttatgtgactaatactttatatctattgaaaagcaactgctcggttagccctttgcccaggcctgggaaaaatcattctactttctgcttctatgagtttgactattttagatactttatataagtggaatcgagcagtatttgcccttctgtgactgacttatttcacttagcataatatcctgaagatccatccatgttgtagcatttgacagaattttcttctttttatggctaaatagtattttattgtatgtatttacaaaatgctgtttacctatcaaaggtcatttaggttttttatatctcttggttatagtgagtaatgctgcaatgaatatgggagtgcagatatctctctttgagatcctaatttcagttatgttagataaatacccaaaagtaggatggctcaatcatattatagttctatttttaaattcttaaagaagacttcatagtgttttccatagcatctgcaccattttaggtattccaaccagcagttcacaggggttacagtttttccacatttttgtcaacacttgttattttatgtttttctttatctttgtaaataaatataatggccataccaacaggtatgaagtgatatctcattataattttgattttcatttttctgatgatcaatgatattgaaaatcttttcatatacctattggcatttgtatgttttctttgaagaaatgtttattcaggccctttgctcatttcaaatcagataattggagctttttttgctactgaactataggagtttttttaaaaattatattttaagtgttaaccctttatcagatatatggttggaaatattttctcctattgtgtaggttaccttttcactctgttaattgtttcttttgctgtgcagaagctttttagtttgatttagtctcacttatctattttttcttttgttgtctattctttcgctgtcatatcaaaaaatgcatttccaagaataatgtcatgaagcttttcccttgtggtttattttaggagttttacagtttcaggtcttacatgtaagtctttaccacattttgagttgctttttatatatgctgcaatatatggattccatttcattgttttgcatatggatttccagttttctgaacatcatttgtttaagaggctatcttttctccattatgttcttggcatccttgtcaatgattatttgacgataaatgcattggtttatttctgggctgtgttctctgttcccttgactatatgtttgtcttatgccagtaccatatttttttattactgtagctttgtaatatgttttgaaattacagagtatgaggactctgacattcctcttctttttcaagagtgttttaactatttggggtcctttgtggttgcatattaatcttttcttttatttctgtaaagattgccttggggttttggaaaggactgcattgaatctgtagattgctttgataccatagacattttaataatatagtattaagtcttccagtcaagaaaagtagaatgtatttccatttatttgtgtttttcaaaatttctttcagtaacattttgtagttttcagcatataagtctttcttctccttgcttaactttattcctaagtgttttattatttttaatgctattgtaaatgtaattatttttttaattttcttttcagattgttcattgttagtgtataaacacaactgatttttgcatgttgattttatatactacaacttttgttgaatttatttattagttctgacaggtttttgtgtgtgtgtgtgtgaaatccttaggagtttcttcatataagatcatgtcatctgtgagtagagattattttatttcttttcatttttgattattttatttctttttcttgttaaattgctcacactagaacttcagtacaatattgaatagaagtggcatgagtgacatccttgcctcgttcctgaccttaggggaaaagcattcaggttttaactgttgaatatgttgctagtggtgagcttattggatatggcctttattatgtttggtaatttccttctattcctagtttgttgagtgattttattatgacagaacattaaattttttcaaattctttttctgtatatcttgagatgatcatgtgatttttatcctttattctgttaatgtggtgtatcaccttgattaatttttgtctgttgaactatcctttcatcatagggataaattccacttggtaaaaaagtatataatcctcttagtgcgctgttgaatttgatttgttaatattttgttgagatttttacatgcatattcatcaggaatattgacttgtagattccttttcttgcagtgtctttttctgcctttggcttcagggtaatgctagccttatacatgagtttggagggggcccctcaaccacttctcaattatttggaagatttgagaagaactgttgttaattcctctttaagtgtttagtagaatttaccagtgaagccattggtcctgagtttttccttgttggatagttttttgttgttgtttttgtttgttatgtttggtgttttaactgattcagtcaccttacttgttataggtctgttctgatttttcatttctttctaatttagtcttggtagactgaatttatctgtttcttttagtttatcccatttgttggtgtttaattactcatagtaatttattataaccctttatatttctgtggcatcaatgtctcctctttcatttctaattctcttcatttaactattttctctcttttcttagtttagataaatgtttatcaagtttatctatcttttcagaaaacagctattagttttggttttttattgtttctattctctattttatttatttttgttctaaccttcattattttctcctttctggtagctttggatccagtttggtcttttcctagtttatcaagttgtagaattaggttgattatttgagatctttctcctttttaagatctttcttcttttttaatgtcagtgttcattgcaatatacttctctcttactactgcttttgctgcatgccataaaattgggtatgctgtgacttattttcatttgtctcaagatatttctaatttcccatttgattactttttaattcagtggttgttccagagtgtattgtttaattttcaactattagtgaactttctaggttcattttggtatttatttctaatttcattccactgtagttagaaaacatacttttgataagttagtcctcttaaatttgttaggacaagtcttgtgacctaacatgtaatctatcctgtagaatgtactgtgtatacctgagaagaaagtttattctgcttttactgactggaatgatccatatttgtttataaggcccatttgttttatattgtgcaagttctctttccttattgatcttctgtctgaatgttctggccattattgaaagtgggtattgaaaggttctactgttattgtgttgctgtgtatttctcccttcagttctgtcaatgtttgcttcatatgtttagatgctctgatattgtatacatatgtatttataagtgttatatcatcttggtgaattgacctttttatcattatataatatccttgctcttgtgacagtttttgacttaaaatgtattttgtctggtataagtatggccatcctgctctatttttttttctttttgaatggaacatgtttttttttccatactttcagtttcaacaaatttgtccttaaatctgtatagtcttttgtaggcagcagataattgtatctttttaatctactctgccactctatgtcttctgattgaggagtttaatgcattcacattaaaggagttcttgaaaaggaaggacttctttttgccattttgttgactgttttctttcgtttttgtagtgcttctggtcctctttgtctcttttgatatcttcctttatgtttcattgattttttatagtgacatgcattgttttctttctcatttatcttctataaatattatctttagcattaccatggggcttacataatcatattatagctttaatagtctattttaagctgataacaacttaacttcaatcacatacaaaaactcttcactttaacctctgtcctcctctaccctttatgttactgataccacaaattacatctttttatgttgtgtatcaaatagtatatttttatagttattgctatttttatgcttttgtctttcaacttctaaaccagaattaaaattgatttatgcaccatgcttacagtattatagtattgtatatttttaatatatttatctttaccagtgaactttatattttatatgttttcagtttatcatttagcatctttcagtttcaatttttagtactccattagcatttttttgtagggcaggtctagtggagtggaactccctcagttttgttcatctgagaaagtacataccttcattttttaaggagagttttgccaggtataatattcttgtttggcattttttaagctctatgaatatatcatccaacttcatttttgactgcaaggtttctgctgagaaatccactgatagtgttatgagagttttcttctacataatgattggatttctgcttgctgctttcaaaattctctttgtctttgaattttgacagttagattatatgtgtcagtgtggacttccttgggttcatcttattggggattcatttgccttcttgaatctgagtgcatttttccttctccagatttgtgatgtttttgttgtttctgtccagtaattttttaaataaacttttttttcttttctctctatctctttcctctctctgttctcccctgggactcccataattcatgtagtggccagcttgataactttccataagtcacttgggctttcttcattctgtttttcattcttttttcctttttgctcctctgactgtataatttcaaatgacctttctttgggttcgttaactcatatatctccttagtcaagtcagctgttgaaccattctagtgaatttttcagttcagttattgcattcttcaggtgcaaactttgttttgctttttaaactatatcttctatatttttgtctgcggaccacatactgagaactgctggtctcagctgctgtaacaaatatacccaagaatacagaagatcaaacaagatatttaataaaataatatttgctcatgtaattgtctaatgcagtggttctcaactaggggaaattttgcccctcagaggtatttggcaatgtctagagacatttttggttgccatgactggggagagagaagttactggcatccagggatgcaactaaacatcttaaatatacaaaacaatctcccagaacaaagaattatctaacctcaaatgacaagttgaggtacagaaactctggcttaaagatgggagttgaggtgaggaagatggttatctcctccgcaagatcatctaagggctgaggttccttcttttctagttgtcgtgttgtttcccaaggagttgcccttgtctacagagtaagtcctgcctcactgggataacatctacttttttgcaagaggaatagaattacatgagcaattaggtaagcaaatatccttttatcttgtttgaccttctgtattcttgggtatatttgttatagaagctgagaccagtggttttcaaggtgtggtctgcagagaaccttataggaaatatctggtgtcaaaactatttttataataatgctaagatattatttacacttttcactgtcttgacatttgcaccgatagtataaaatcaatgtctgataaaactgctggctgcttagtacaaatcagctgcttagttgagaacaataaatggactcaagaaaataacgtggaagttgtacacatccttccatctacttacattccattggtaagaacttgtccaaatggtgaggctaagaccttgacatggaggaaggagtccatttaaaagggaaattcagggaatggtttctggggaaacactggcaatatctgccctgatagagaaatgctttaaagcttttgaaggcatgctcaaagaagtcagaggccttttatcatagaacaacttgaaatttttatttatgtataataatactttctatatgtaaaagaaacacatttcttgttatattttgcaaacccatgacttacaatgaatttgccattcactttctggagacaattaattcctcggggatataataaatattcttgcccaaacgaagaatgtgttactttggaagaggtcattagcttctacaaaatgtaagtaagctgatatcttactggtttatgggacttatctttgggctttattaaaatcctgcatttttaacttgaaaaagaaaaggaagacagacattgacttactgtcaaaatcaacaaggtctggatgaaggccccttgaaagtctcatccctgtgagccggtaaacatttatatctaatttgaaatgagatgcttaattacataatttcattccaattaagctgctaattaattgacagggcacctttgagagctttacacagtgcaagtaaaaggcaactacatcttgagtctattacctatgaccgtttgggagagatcagtaaataactatttaagaggctggagacagagtttgcaagaagagaaaacaagaggctagccctgggagatccagactcaggaccagtcctggccaagactcttttgagcttttttttcagtctatttcttgagtgagtaatgaaaggaaacaaaagaaaaaaaattctcttactgagcatttactacatgtatgtgctaggaagctgcaaatgaaaaatgtaagatgctagactatctgcccagttgttgttttaagtaacactgttgtttgggcattaagtaagtagttttgctatctccctggtatttaacttagccaggtctttcttcttgtttttccatctctgagctttattctggggtcaaattaaagcttattttgtgtacagatcatcaatgtctatttaatctccccagagggtagtaatgcttttgttgatagtgaaaacaattccaaattgacatcagtttttcaaaataaaatggattattttactacttgcatactgcagcttattagagtagaaacatataacaataaacatctattcatacacacatgcatgatacttcacttgcctgcactggagaagaaattattggaatgtatctttttcatccagtttaatgcagaagcagaaacctagggtggacaagctggttgtctcattactgaacattactgttgactcaagagtctttccacattacttcagaaatgctccaggactgcattatcacatctttacatctcatcattggttttattctaaaaaattaatgaaacaagttcgagttaggtttatcattcaatctaaagagtttcgtgtagtatatcacccactattatcacctagtccataactggcatcatgcatctttttaaaaatattatttgaataggtacgtttcctcacagatatatcaactattgtgcatatctctagttctgattctagttaatcaatatcagcagaaagcttatcatttcatgtctaagtgtctgtgtgggcatgaaattgttaggaattgttttagtgaataactgattcaaaaattcattgcttaaaaacaagatttttttttacagaagcattcagaactccaaagagattataactcacagagaattattttaaaaagcagataatatcttattccttttttccacacatctccacataccaacttaaatcttcaccagtaaagaggaatccaggggaaatcataagagaagcatctttgctatcctcgctgaagtgagagacagtgaacttttcctttgctcatactcagtgcctagaatcacctaggaaagccccttcccatgggaactcagcagccatgagcaagctgcccttacaggctccatcctggtcactgacaggttactccggctgtgaccactgaggtccacttccactaatgcctcagaattttaacctgagcctgacaaatttgcagggtatgtgggcacacattactgtatattgcagctggaatgcaaacaaagtggaccttaatggcaattaaatcccaacccctcattgtacagatgaggacctttaaatgcagataggtgacaagcaaatatttggttgtggtcaatgttaatgttgaattgattacttaatcaaaaatcacgagattgatccatatttagacaaacatctatgggcttacacaccgatggaatttacaccttatgtatctgtatacattatagactttctggacattcaaatccctttcgtagaagattctgaggctttgagatactggactctggtctggtaagacttgtttctctccacatggtactgccagctgtaacacagggaatcccacttaggagcatatgcagggaaaatgatcatcactttgccaagccctgttttatccttacttcctggcatcaaagctatcttacctgatcttactttccactagaatagagcccaatctaggccatcacccaaaaactggaggagactttttggtagatacttgtaattgagtttattttcatatatttagtttaatgcaaaatataaattaatgaataaaataaaatattcagaatgtctttttttaagccaagatgataagcattccttagaatgtatgtgatggagtaatatgacacatgtggactagaatattactgaggccgccaacagagatggcaacactaacaaaagtatggcttaacattcctaaagctttgatttgttgccttcttgagaggaggtagttttaattcgcttcttatatgccattaaggcatcgttgcctctggatatttatgtttacttatcagtttatgatagctattgatttttaacagttattttaaatctcttgaagaaacacatgcaaagatattttcaaaattcatagtttgctgttaatcacttatgtcctgaaactattgctaagcaaaagttttcattatttgttctttgagggagtataaatttaatttagagtgagaaggataaaacccaggattcgtcaccatcatttcaaaccagatactgtgattttttttgcggggaagaggttgagagaggcttcctggtttgctcctttgttgattttcttacatatttgacagtgtcaacattgaggctcaccagatcactgccaaagcccattgtgaagagtggctgggccagtgttttaattttggtatatattgaaaggatcgtattctataattgactatgttttacttagatggcattactgaatgtacattttcagaatttattttgaagactgacatcatagaagaagctcatctagaatactatgttcaagcctttgaaatactcaaagaactctatagattcagtgtaatccctatcaaaataccaatgacagtcttcacagaaatagaaaaaaaaaaacgtaaaatgtatatggaaccacaaaagagaatagctaaagctatcctaaggaaaacaaaactgaaggaatcatatttcctgacttcaaattatactacagaggtttagtaaccaaaacagcatggtactggcatacaaaaagacacagacatcaaaggaacagaatagagagcccagaaacaaatacacacacctacagtatactcatttttaacaaaggtaccaagaacatacactgtagaaaagacagtcacttcaataagtggtgctgggcaaattggatatatgcagaagaaggaaactagacccctatctatcaccatatacaaacatcaaatcaaaatggattaaaaagttaaacctaagacctcaaactatgaaagtactacaagaaagcattgcggaaaatatctaggacattggtctaggcaaagattttttgagcagtaccccagcataagcaaccaaagcaaatggacaaatgagatcacaaattgaaaagctactgcatagcaaaggatacagtcaacaaagtggagagataacccacagaacgggagaaaatagttgcaaactactcatctgacaaggaatcgataaccagaatatataaggagctcaaacaactctataggaaaaaatatctaataatctggtcaaaaaatgggcaaaagatttgaataaacatctctcaaaaaaagacctacaaatggcaaacacctatatgaaaaggtgctcaacatcattgatcatcaaagaagtgcacattaaaactacaatgagatagaaggtggtgtaccagaggctgggaagggtagcgggaggctatgggagaggtgagggtggttaatgggtaccaaagcaaatagatagaatgagtaagagctacaatttgatagcacaatagggtgactatagtcaataattactttattgcaaattttaaaataactgaaaaatgcaattggattttttgtagctcaagaataaaattaaagaacatggagaagggcaaaaaaaactaaaaacaaaaattaaaaattttaaaaagccatgaaataattaagtaaactggatattcacataatgaaatggctacttttgaaaacggtttaattttatataaatataaaaggtagcctcccacttcccttcccagcctctggtaactctccttttactctctgtgtccttgagttctgttttgatttttaaatcccacaaacaaatgagaatatgccatgcttgtctttctgtgcctgaatagttttgaataactctatgagaaaataaatcagagattttaccaaaataatagagttaaacataagatttttcaaaattttgtctcttttctagtttccttaataaatgtgtgtgttgttatatatattaagaaattttaggccaggcacagtgactcacacctgtaatcccagcactttgggaggccaaggcaggcagatcgcttgagcccaggagtgcaaaccagcctggccaacatgaggaaaccttgtctctactaaacataaaaaaattgggctgggcgtgatggctcacacctgtaatcccagcactttgggaggccaatgcgggcagatcacgaggttaggagttcgagaccagtctggccagcgtggtaaagccccgtctctactaaaatacaaaaaattagccaggtgtggcggcatgctcttgtaatcccagctacttgggaggcttaggtaggagaatcgcttgaacctgggaggtggaggttgcagtgagccgagatcgcaccactgcactccagcctgggtgacagagcaagacttttctccataaaaaataaataaataaataaattagccagatgtggtggcgagcacctgtaatcccagcttcttgggaggctgaggtagtagaatcacttgaacctgggaggtggaggttgcagtgagctgagatggcatcactcaactccagcctggacaacagagcgagaccccgcctgaaaataaaaaaacaaacaaacaaaaaaaacagagaaattttgaacaagatatagacgattccaaaaggagcaagcaatatggcatgcagttcagaacggggtcttccaaatacaggccctgacttggtcattgcaggccatgtgtctttgacaaaacacctttgcccaattacttttatagtgaaaaggggacaataatagtgcctactttctaaagttgctgagagggttgcattagaatgtcttcaaaaagcttatcacattgcctgtcacaaagtgatattaatgattatgttcataataccattaaaaaatttattactttctaagcaggaaaaaaaaaattcaaatttaggacagtcccataataagaattaatttattttaacaaataaagttatggcttttgttttaaattgaaatagataatttaagtactttctcttaattattttataaaatgtatggtgttttaacatatgcaaagttgatatcaattctattttcttaatctctcaaagttgccacattgctatagaaataactgtaaaaacatgtgatttttccttccacttgtatctgaacagcatttactcatttaatccaaaagctgaagagatgaaaaattgggagatagtggtttcactgttcacagacaagctttcccactggctctgtgacctcaaacaaattggtttactcctctgtgcctctgggccagtgaggaagctttcagctgccaactagggaagaaactcctgagaatgccttcagcaagagcgcagccaaggcagagtagctccagggctggttaattcagttactcaaggacagtatctaagatctaaggtttcctcccaactgtatttcctgcattcctccgtatctgttttcttctcatttttcccctcatgcacacatgttggcccaggcattacccacagatataactctagtagagacaggaatgaatatgtcttttctgttgtatgcttcgtaagactgagaatctccttcctacaactccccacctcaggatctccctgacgtggcactattcagaactgggtcacatgtcacccccagtcactgccaagaatagtgagattgctttgcttggttaaagcaggatgagcttgttagagtggttagattaatcaggatttgtctccgaggtggagaaggtttcttctgtctaggttggacagtttagcaacatttactttaggattgaattgacttgagtaacaatgcacaacatctgctgaatccttaatttttttagtctataaaatagggcaaagttcagttttatctaggtcacagaatttttaaaggataaaatgatataatgtcagctcaggcagttcaagcaagcctatgactctcaaatgaacagtggtgctttcatgataagtctaagaatccttggccaattatgtataaatgcaaccctagtctctccttcatctcctttcccactgttcagccatggctttcagagttcatcatttatttctacattgacagctaccccaatccccattccaaattcacatgatgataaaatgtacaaactagatgacttccaatcttcttattttcttaacaagtttgcaggagccattaataatgtagagcaaaatgcagtctcaggtgtgtataccaccaagatgtaacttacaaaggtaactctacaagagggaacttcattccatgttgtaaaactaccatgtattccttctgtgtaagtgggcacagggagaactcaaagtgtttatggcttagcatgcatgctttcttaccaaacactgttcttgtcccttgttgtggccattctgagttcttttatgcaaatgtgacccactaagaaggattgatttgtgctcaggcctcagccaatgcccattttcttatgccctgggatttgtttcctagctgcctctggccctgcggttgagggttcttgccagttcgattctaatacatgaacactttcctttcattctctctttctgatttccctttgcatttatctgctcccatcaatgcaaaatactgaatggttcaaattgattttccttctcaaaacaggaaaggtctgtttttcaaacttccgtacttcctaaggaaatgtctctgatcaatatgtgtaagaattaaggggaaacgccagactcccccttctgattgtcagtaactcagtgcaacccgtttacctcttaggattcttcccagcagaaaacgctaacaattgcaattatcaccattatgcagtatgttcaattgtacaatcaatgtaattgccaaatggaaattatacaataaatataattgctgctttactcctgtgcagtatttcagtggcacttcacatttattttgtcttttaattagtaacaggtataattgcagcactacactcagagctgaagctgaataatttgtgggagtgggcatagggtacagatattgaaagagggctgctgtggttcattctttgctggaattatctaaagatatccacctattgtctaaaacccacctaacagccctaaattgagctgacctgtggacacatttggtgtaaactccaggtaaaaaaattccctgcagttcctgaggcacatgactttgccatccctgctcttgacttcctgcatcccattgtccctattatttgtctatctagatgaatgtattaattcattgatttaataagcatttattgagcactgattatttacctgcaggagatatgtagtgaacaagagaggcatgaagcttaaaatctaggggaaaaatgcagagactacataaagagcgaatcaagtggtaggaaatgtaaggtgattagtgctaaaacatgctaagaacaaaaagttattatgacgtcataatatcttttgatttgatggtcagggagaacaactttccaagacatgatattcagcttgagatgataaaatgaggtaggttgttcaagtgggggtggaagaaggaagaaagtgagagagagagagagagagagagagtttgtgaggtgtgctggaagaggtagagagagaagagcttagatttagagggtttccacattataataaagaattagatatttattataagtgcaatgggaaaccaatggagagtttggtgcacgacagtgacataacttgatttctattttcttttactttttagacggagtctcactttgttacccaggctggagtgcagtggcatgatcttggctcactgcaacctctgtctcctgggttcaagcgattctcctccctcagcctcctgaagagttgggattacaggtgtgtgccaccatgcccggctaatttgggtatttttagtagagacagggttttgccatgttggccaagctggtcttgaactcctgacctcaagtaatccccctgcctcgacctcccaaagtgctgggattacagaagtgagctacaatgccagaccttgatttccattttataaaaagtctattctgactgttgtataaaaactgattgtagaggaacaagaaatgaaagaaagcagatacagagaaaattgtcagtgtctgggtagaagtttctggttgctagacctaggatagttctggtggagatgaaaagaagtggagtgattagaagaacatttggaagtggattgccattgctggttgacagaattgatgtgaatggtgagatcaagaatgaaattccgaatggtgctaggcttttggcttggaagttactggaagtctttaaaaaagaacagtcttattagtaagaaaacaaagcttgttccatttgaaatgccattagacatccaggtaaactattggataaataccctaaggggagtagtcattaccgtagatataaatgttgaggcttaacggcattgacactgaataaccctggaccagggtgagataaacatcaggaacagaaaacagaagagatctcaggattgagttgtgagtttttgcaacatttagaggttccacagcgaggaagaattggcaaagaaaattgagtaatagctgctagtcaggttgaaggaaaactaggaaccactccagccaagagaacctttaccaagaagagaaaccttaacgatgtgaaattttactgagagtaagaagaaagcaaagctgtggtctttccatttggtaatgtggaggctgccactgaccttgtcagaacagctttagtggagtttttaggctacatatatgatatgtgtgggttgaaaaaaaaatgaggtgaggaaatgaagacagcatgcacagatgatttttggagtgctgtgacaaagaacaagaagcccagttgtaggtggaggggcacatgggtcagagaggctgttggatatttttgtatgcaagtaagtgtgaaaagtgagaaatggatgctgcaaggtgggaggtggagtgctttgagaacaaagtccttgagtagatgagaagtggaatccagagtataagcaaagaggctgcctcagacaggaacagaggcttgtcttcctctgtaatgggagagaaggcgagagtgtaggcatggattcgggaaggtcagtatgtgacagtaggaggactgctgctgcctccccgtagttcgtgatctagaggagagagactcattgtacacagctcactacatgagtcagacagtggtctgagcagacagcaacaactgctgtgagagggcaccggtgggaggactctgcctaccaaagtttgacagtgcaggtggcatctgactttggcgttgaataatagatattattatcctgttatttgacttagacatcaacaggtataagggcatttcctctagaaggccgcttgcgaaagacctcgtatcaagaaagactaaggaagacatataggttgatctctttttccacagaaccctctcaggcatcagtgctttttcaaagccctgttctcctttgaaaacttcctctctccctttccttggctattttctaattatcttgcaaggctaagttgaagtgttcctcttccagaaaaccttcccagggcctacccccaaaccccttatcaatttgagttagattccttcctagatgtaggtggagcaaaaagatagtggcctctattttttggatgtgttggcatgagtgttggctttatccatctggtagaacaagaagcgtccatggtggtagccactcaagagctcaggcaaaatggtattctgagccccagagggctagattgaaggctgccaaaagagaacagtgtttgcaatcttggaaaaaatccttgttcatgtttccatggacacgtgcagttgagtccagctttgcacttcactttggtcaaagagtattttgatgtgtatcatgaaataaacatacaaataataaaaatcataaacaaaactctcagcatatgggtcagaaatcctactcagtttgtcatttatggtgggactcaagtactatcagcaccaactccacagcccagggatgaactttgttgtggtgtctgataggaaagttcaatcgaacaagctccccccaccatatctctataaaacagtcttatgctatgctatggaaaaggtttcagttatttgtctgaatatggtgggaggataatatcacctgcaccacagatacccatgccccaacccccagaacatgtgaatatgttatttgacatggcaagagggaattaagtttgtggatggaattaaggttgctaatcagttgacattgaaatggggagattatcctgcactacctgggtaaaattaatgtaattacaagggctcgtataagtaaaccagagaggcaagaaagtcagtgtcagagggacacagcatgaaaaggactcgactggccatttctggctctgaagacaaaaggtggctgcagatgaaggaatgtaggcaagaaaaggcaagaaaatagatacatcccctgcagtctccaaacggagcacagctctgctgatattttgattttagtccaatgagactagtttcagatgtctgacctgcaggactgcttttttgtgtgtgctgttttaagccataaattttgtgaacatttgttgcagcagcaatagtaaactaatatccagtgtgatgtacctctgtgcctgaatctgagactccatctaaaacccgtgcacagtcacagtgtataaatgggtgacaagatgaaaacatggcgggattcataagcaaaatgctgtgcctcagaacagtgccctttcagtaaggggatactaaatagatgacagtttttaaacagaacccctcagaacttcagtttcctcagcctgacatttggggtagtaacacatttctacattagaaggagatgtaagtaagataatgtgctatgaatggttttgtaaacatttataaatttccttgtaagatctctgcgatgattctaatactcttttgaagcactagaaagtacactggcctgagaaatgcaagagctgggttcaggtctcactttcaatgcctgtggcattcattacacaacccaatttatctttctgaagactccatttgctcatcactaaaatatggataaaaagatttagtcaactatgctaaaaggtaataataaaagtaaatgcacttttatttatttccactgtgtgtgcaaataattattaataaaatatgtcaccatacttacttctcattcttggtcaataaaacaatatccacaattccagctctcactgtacaaggtctctacatgagctacagtgagtgagtgagtgagtgataaggaagagggtgaatggcaggtgcaggaatgcccatataattggtgagctctttctccagccactgtgtccaggatctatgctcagatcttaagacaatccctgtagtcctcggtagaaagcctcttaggaatcactctttcatatttagatttattcctgggaaacttaaagctacctcaaacccagttcttttgctcagagttctcaacacaattctctgagttgtctagtgagtagaaatagaagccagaggttcatggaagtccataaacgcagtgtacatgttaagcgtttaagaaaatgctgtccgtcttgaaagcagatcaggaatctaagagtcagggtcattctctgtgactgcagtcaagatgagagcaaccaactggccctcacaggaagttttgggaggcagaaacttcattgattcatctaccttcagaatttcacatagcaccaggcacatagcaagtgaatgaatgttttatttaaaggaaatctgctcttttgaacaatataagtcttatttttttcaaagagatgtgtgttatcaaggaacttgatatgcccagaggttaaacttagttttctgactgccatttctatagtacaaaggctccagggtgctttctgtatggattagatgttaggcacacaactctcccaaacaaaactaaaaattgttccacaaatgtggaaagtatagaaaattaagtaatatatgcaaagtgatgagaatggtacacagaaaagagtgcaatgtgtttgtattatgctatgtgatctggcataggttcaattatattttcattgataattttcctataaatccatgctttggaaaatgacctgtctttgttttccctaaaggtaatgttatgcctgtatttgtgtatcttatcctagataaacaacaccagatgttgaaagagcataggaaggaccatgtgatatttatcttaagataatactagaagaagtgaggctattctagaacttaattgattcctgataaatctgagaaacaaaaattttgagtccttaagctattcatgatttccatttaagaaaaatttgtctctattttcttatttcccaaatatgttaattattgtaaaccaaatagaagcaataactgaattcttcattaataaagctgctttgtttaaatggctgtcgacatcttatattattatatagaatattatggtgacatagtcttatcaaaaaagagaacatttaatcacaaatttgtaaagcaactggattttgaaaatccatgaacattttgtacacaatagttgatgttaccttatgaaaaataaaaccttacatggttgttccattaaaagcccctgcttctaatacatagctattattttattttcattaaaaaatatggggacggaaacactgaaaatatcacttgaagataggcacagcctgtctggtttcttttatggtttttcagattccaaacggaagaaaaagatatataaacactacttccttgggtggcagatcaaataaaggacagttttgtttttgttttgttttgttttgttattcttgcaaaagctcttagtgaggtagaacaaaataaaagatggtttaaaacaagagaatcacatttatattgcttggctgtcttatttgtaggaaagaagataaattctttacagataggtaacagcactacccggtgctgactatttgagtgggatatatttccagttcattaaaataagcaaaggtgatttaaaaaccttcaacttcttgtacagtcacacttatcaacctaggttaattgggagaaaggccatatttctctctgaggtttaaaaaagtgttgtttcattcatttattcgctcactcattcattcaccccctcttcaaattcataaaacatcagttcgtgcaaggctatgattctaactaacgtactgaaaataacttaaggggccgggcacggtggctcacgcctgtaatcccagcacactgggaggtcagggtgggcagatcatgaggtcagaagttcgagaccagcctgaccaacatggtgaaaccccgtctctactaaaaatacaaaaattagccaggtgtggtggcacacatctgtaatcccagctactcaagaggttgaggcaggagaatcgcttgaacccgggaggcggaggttgcagtgagccaagatcacgccactgcactccagcctgggcaacagaacacgactccatctaaaaaaaaaaaaaaagtacaaaaattttctgggcgtggttgcatgcacctgtaatcccagctacacaggaggctgaggcaggagaattgttggaacctgggaggcagaggttgcagtgagctgagaccttgctacccctgcactccagcttgggtgacagagtgagactctgtccggaaaaaaaaaaaaaagaaaagaaaaaaaaataactcaagtaacaataactaagagtatatactaattatttaattcattaatcaatttgttcatttttattgcctattatgatgtataattccaagtttctcaaacctaaaccaaaaatatgaagcaaatttgtagtgcaacctggaagcttctctccctgcactctaattctgatatgttggtgcagctctgcttagttcaaacatgttctgggagctgaggtatttaatatagttcatgctttaaataccagataggttgggaaacactttcatttgaaaatttatgtgaatatataaactgatctgttaatacaccaatttatttatgcaaatgtgtatttgtggcccttaaagtcaattttcttaaatagaaatagttttaggcagtttatgtaaaacgttgattttctcatccatttgcacttacattaacttctgtatggtgacacaataaagatagctatttgttacttggtaggttagcacctgtcatcaatatttggagcactgcctataaaaccagacttagataagggtcaaggaagctatctacacttggtgcctacaatattaagtttttctgtatcaatctaatttccagattacatttctttttttttcatacagtttaacgtctgatgcccgctatctgtgttattgagagtgtgcatgtgtgtgtgtgtgcgtgtgtgtgtgtgtgtgtgtgtgtgtgtgttgccaggaagtagaataaaggactatattcgtatcagagcacttaggacatcactgtggagattggtttattccttcagcctcagtatccttatccgaaaaatgtacataattacacatagggttgtcataagggttaaagtcactctttttcaacaaatttttattgagcacctccttaatatcagacactattctaagtactggaaatacaacagtgaacaaaacaaaatattgcataaatgacaatgtgcattcttagcattgtgctaataaattaatcttcaattattagtgcaattggtgttgttgttgaggtagtggttggtagcagtagtagtagcagcagcagtggttcagtaatacttactgactcctgtaccagactggatatttcctgacacactgatatgaactcctaataaatagtgcctactaaatacctggcatggagaagagatgcacatatttgttgaattgaagcattgactatatgttttcatgcatatttttgtaattaacaaatgaaagaaaggcagaaagaggactaggatgaggaccatgtgatggaattactcagcctgcttatttctcacaaggaatgaggggatagggatataggaggagattggtggcatcgatgtctaatattatttggcaaataaatcaatgatgggttctaactctatctttacaacaaacctatgacgcaagaggaagagagaaagtaagtcgcatgcccgaagtcaagcagctagtactgcaatgaattcagaaaagaatcaggcctgttactctccgaaggcctttctctttctttatcctctgaagtaaagctgaggactgctttttgggtgaactaacacttaggagttgagagtttcagaaaaagggcttgcaatgtcatgtcctattgccactgaagaagaaaaaggcacaccaacttcacactcagctactccaagttcagtttcaattaaacataaagagacagctgggccgggcacgttggctcacacctgtaatcccagcactttgggaggccgaggtgggcggatcacgaggtcaggagttagagaccagcctggccaacatggtgaaaccccatctctactaaaaatacaaaaaattagccaggtgtggtgacaggcgcctgttcttccagctacttgggaggctgaggcaggagaaatcacttgaacccaggaagtggaggttgcggtgagccaagatcgcaccagcgcactccagcctggtgacagagtgagactctgtctcaaaaaaaaaaaaaaaaaaaaagacagctgtggtttcaggctggaaccactggagccagaggggcctctagaaaggcctggactccatggccagagggaaggagtttcacaaacaggattttgatagcactttagccaacagttctttggtgttctaatactgcttgagaatggttttgatgtctcataaggggttacatagtgagttatctgaaatcatttctgtctcaaactgtccagtctcccttacggtgctttagtcaactcttcgtcttctcagtcttcatgttaaaaggaaaaatcttagtgaaatctactacaggagaccagctaatttcttgaacaatagtgaccattttggtgagaggcctttaatagcggtattgagaaggcaaaccttcaattagaactgaaaaagttgtctttttttttagcaggaaactggtaaagggggtatctttgcacaaaagcagtcatatcagcaggagacattgtaaaattaaccagtcaagatacctttcaaaggtaactattaagaaagggaaaccatgtaacacccacctttcagcaattttttctgtaacattttattaagtatcttttcttaaacaaatgcaaagtgtattttacttcacataaatttgacattcatttcatcgttcattttgtgtctagtatgtaagaaattatattcaattctgttgaggatttagagaagagagagacacagcttatgccccacaggtacataaagtttagatacgaagacaattgatatacacccatcaaaatagtagtaatcaaaggaaaggaagaggaagaaacaggtatttcttgaagacctactgagtacctgccagatacttattattgttttcattttaaacaggaaacagaagtttagatgggttgtgacatttgcccacgttcacacaggtatagatttagagataagactcaaattcaattctgtctcctcccagagccagcactgtgttcactaagccccctgactcacacacatgacacagggatctggagatctctgctgaggtgttgaagctttgaggaagagatagcattttatacatgcattggagatcaagttgtaacaaatggaattttagtacatagttattccagatcatcatcttatggattgagggggtaaatgaaggagcatgtgagtcttccttggtttttccctgaagtatttgggaaactgaaggcaaaaaaaatccaaagtccaaagcgtgcgtaagagtcgttgccacttttgagagaataagtctgtagatacctttttacctccttcggtcaatgaataagtgctactgagtaaacttacattattttctattttacaaattacactatcaatattacttggaaatcctgttgcctatgtatttctacacagatcaaagcttttcctgtggtcggaatgctctgattgaatccacaaatcttactagttgaatcaaaatcaacggcttaaatgtcaggatctctatctgaggagctgtagacccctgttgaggttttttttgtgtgtgttgttgtttgtttgttttttaccaaagtcccccgaaagatgaagagggcattgtcttgtaaaaggagggacgtgggaagatctgactagaagaaaaacatgtgtcataaaaattactgaatgctattagactatataaaagtcagttcttaaaagtcccttagcaaaaaagcacatttgtggacaacaagctgttcactttgattgatgtgtgatatacacataggagtatgtgttagattaactggaggcacattagggaggacatgaatgtcaggatgaagaagttggagtaactgggaataatttgattattttgagcagagaagataatcattgcagctgtgctttagaaagaccatctgtgagtcatgtgtaggacggattatagaaaagagtgaagacacagcaaccagccaggagactgttgtaaaccttcaagcaaagatagcaaaatttcagattaaatcagtggtgatgaaaaagaagagcttgagttggattctaataaatactcattggaaatgagtattccatttccatgtaaatggacagtaggctacaagtagcggataaagcagaagaaagcatcaaacacgcctcctagtacttgagcttgagaaattcagcttggtttgagtttgcatatagtgaatatttaaaaataaaagtagcttgtactctttcacataggaattacaggatgtagtcactatggaaggtcagttcactgtcttttaagaggcttctctcagtagcattgctttttctggtgaattcagcataaagactaggcttagaaattgactttgtctggaaattaaaggcatatcattttttcaggggtgacttcacattaaaaactatcataagacatataaaattagaatgcaaaattagtacattataataaaaaataattaatggccgaatatgaatatgtttagcttccattcttactttaagcataccttcatgggaaattacatcacataaatcaaaaacaggatgttctttgatgaacaaggaatcaacaatgaaagttggatgggtcaaatatttaacaacagccaggaacatccatctgccaacagaaattctgtttttaaaaacagaatatttagcattctctaatgcagtctactgcattaagtcaggtttgcatgataacctgacttttcattatgacttttttttggttctttatttaactgaccatcagatttaatatgttaatgaatgtaaataaaatgcatcaagagtatagtaaattcttttgagagtgggcagttttctaactctttaaggtatcattttgtatcttgattcattaaagttgactgtacaatttaattctgagtacagtggtgtcttttattttgcaatctacctcactgtataacccacatattaacaggagctttatagaatctgaggggctggcaggatataaagatatacattaatcaaggcaactattgttagtttgtagtaaatagtcctaaaataccactgtcttactacaacaaaggtttctttcttatacttatcacagtctaatgagggtttgttagttctccattgactctctcccattcttcacctaggggtgttcctggaggctgccctgattagctctcatcagtgggctcctttgccctctaacttctgatttggctcagtcagtggaggacaaccactgtatatgactgaagagcaagagaggggatttagctgcagtgtttatttctgcagtgtttcctttactggcagcatgttcctattaaaaggaaattctccagtcaagtggcattcgctgtacaactctctctgtgttctggaatctagtttcttcatttgttttctcaggcctaggagtagtaatatctctccaccattactagccctgggggtattacatcattcttcattgctaggtataaaatttgtcctcacctatataagagatgtcctgtaaatctcttctcaatttctcaacttgggtgtgccatatgctgtctacttgaactttgacatgtattctcaaaacagtgaagtggctatttaagctccttctttcttgtgatgctatcattttaaacacatgctctctaaggttgctgcagaagtggagacagagtgaggatgtttgcacaaggttttgtgcttagtcctaaacatggaagacattgctgcctatatgtcacatggctccaacataactgaagtggggttttctcatagactcagacaagttgggaaataatgggatttggtgagcatttggtattgtttgtgtcgtacatggagatatgcaataagcaaatggaaatgtggacattaactcaaaaggaaggatgatattaaatacataggagaactttagatggcacttgaatgttataccaattcaaccccatcatcagttttgaccacatctttccatttcttaaacatacttcgttcccactacagatgccatcttggttccttctctacctctattttgatattcacatagaccagtactacagatttcagttatgtggttcttctgggttccatctgtttcttttcattgtaactaacagaagcctggtctgatttgctaggtgaagctgtacaagtgaaagagaaatgttggagagatgtttcatggagaaaagatagccagacagactccagattacgtccacgaatatagaagcaagaagagaactcagtaagaggtatatgaatcaggctcagtaagaggtatatgaatcaggacaatatcatcaaagacagtccaggaaggaggttcaaaaaagaagacatggacagaagtaccaaattcagggatatgtgagaggacatgtggaaaagagctctggatattcatgctcacagtcttcaccaatagtggactgaaggaaaagatgtcattgaaggctgtacagccaccacaaagaggagggagtttcagtgcaaagagggcatgcatttctttcatcttcatccttacttctttccgaacttcaattctttgaacagtctacttgctacctgcctgaatcctttcttaatcttcttcacatgtactccttcaactccagaaataggttttctgccttttctttgttaggatcacatttcatttatgttctttaatccaagtcagttcccaatcattgcttaacaagacttggcttcttattgattctctagttcagttgcaatggtctattccaaatcttctccaaacaccttaagctgccatccaccatataggccttactcaatgatgctctacttttcttccttctacctaagacaactttgctttgacacctctgtaggcctaagaaagtggcctgcaaatatgttgctattcactcttctcacctcccaaaataccaccttaatctctcctgcttaatttgcatcttcaaatatttagtttctctcttattgcttacccctttgtctcaggatctaagaacaggtttagaacagataactgaaatctccatgacctcctttagataatacctttggtctcttccccaccagagtctgacaatttactaaacaaatgaccgttctcattggtttaatagccagttcttttcattttcccctgctgcccctctgcaggaattactaataagctgcagacttgggcagtagcaggcagtagggatggctagaggtgaacagtggcaggcagacccttctgatcctcaagcagcctgcctggaagtgagcatgttgcaggaatagtagtgttatctcttgagatagatttctcttgtgtcttctaatctccccccaatgccagtgttatgtgtgtgaaccacccttgaaaaccatcttctgctttccatttggctttccctttgggctggctgtaatatttgcttgctttcctatgtcaggactctttgaatgtatacctgtatcttgtagctatctcagggacctttacaccaagctacatattaaaatagttttctctatttagtaattctatgtttcttctttatcaggatattccttctcacttttatccccaaaatggaagaaataacacgttttaaaaattaattgcatagcacatttgcaagttatgttcccgtacttagtccagtttaagcctcacgccaaacttatgaggttgatattcttacttctatggtacagacaaattaattgaggcaagaagcagctcaggcccttgtctagttgactgctgtgactcatactttctgttcttggctgctgagtcccttgctccacatttctgctttcctaattgtttttgacacaaggaaatgagaacatgttggaaaaacaatagtctttctggatgagttgttgggctaagtgacctttaaggtatgttctaatctagaggtctttggttcttgcttgattatagtgcagtactattagacaatcaatgcaattgtcctagctgaatgacagggtagcagagacagtgaaatattatttttggcacttttttagtgttatctatttttgtcgatagaaaaataaatcccaaaatccaaagggaaaatatatatttatttgcacttagtgttcagtagtgaagtgcacgggtcatttgttagtggatgaatgtgggcaagttactttacctgtccatgatataactccttatgcataacgtgggatgaataacatgtctactcatagagtttttctgaggttcaaattagtgtacacatgtaaagtgtttataatggtgcctagcacttagtaagtcatcagttaatatcagctgctgttacattttgtaaaaatagtaaagccgtgtgtagcggtccgttctcacgctgctatgaagaaatacccaagcctggctaatttataaaggaaagaggtttaattgactcacaattccacatggctgggaaggctcaggaaacacacaatcatggcgaaaggggaagcgggcatagaccttcttcatatggtggcaggaaagagaagagtgaatgagtgaagggggaagagccccttataaaaccattggatctcatgagaagtcactagcacaagaacggcatggggagaaactgcccccatgattcaattacctccacctggtgtctcccttgacagtggggattatggggattacaatttaagatgagattttggttgggcacacagccaaaccatattactgtgtaaagaacttaccacttttaagaatagttaatattaattgacatacagtatctgaccatttattacttggaaaactctatctgcactatctcatttgacctaaattatcaggtagaaacaattatgatcacaatttaaaagatgagaaaactgaaatatagggaagttttttaacttaagtctcatcgatataaattatatgaaatgatttaaaaaggtgtgtctgaggagaggcagcataactaattagcataactaatatgcgaagcctttctggactcagttttggactatgtaacaattacacaaaattggaagccttttaaatgcctttgggaataataaataaagagttgcacctggatttcatttttaccgtaatcaaatgttttatattaggtattttggaaaactactggaatgaccagcaagattataataataattctggagccactttactattattgtctcatttatacctctcagcagaggctggagcacatggggactatgccattcccataaccatatgttttaccaccttgctctttgtcctgtagatgagcaagcaaagaagcatacaaagagcatcctataaaagagcacgaacaaagacaatgtttgaggagctctgttctttggtcttcccagagtaaatatcagcaatagtaggaaaaagtgtttaaaacacgtatgaggggaaaaaaaaaaactacaggaacgtcaattacaaatgattattttcaaaaataaaaccttctagcttttaactagtttatcgcagagctaaaccaatacagtttcatgcctcataacaatttaataaatattactaaaatatggcaactgctaccatggctcattagcaagctgttggtgtaatataaagttatccagaattgttttgggtagttggtttgtcaatataatgcacacagtaatctctgaagaaagtcaggaacatatggtccatgttcatcagctaaccccaggggactgcaccagaatctctcttcttacaactacatgacgttgagaggagagcttgagagaagatagggaaaaaaagaatgggtggaaagagaaacattgattactcaaaccataaaatcacacttgcaagcataaatcaagaatcacaaagctaacatcttcaaggaatctgttaaaatacaagttgaacattgtagcatcagaaattctcagaatatgaattctgaatcttgcttggcacacagctaaagttaatcatttcagcagcagcagtaaaatgctgcatatagcatgctactggccaacataaatgaatctaatgccatctatttaccaaaatcaagattcctttgaatatattttcaataatttatatgctaagatgtacatacatattacactctctctctcaaaagaaacgtcatattttctaatttaaagagacatatcttgtccaattaaattcgtttgagtaggaaactgtagagttaacaactgtcaatgatcatctatgtataagtagaattatacactttaaagattatgtttatttaataaccatccctatttcctgtaactgggcaatcagacatttttttgacccaaaatatgaccactgcattttgataactctaacagcacaagatgaggtctggctattagagccatataatgatgggtaagtattttgttttcttgggtgctttcacagtgtaaatattatctcagaagtgggtttttagggcaattcaagtaggatgcttaggaatgtacttttctttatttggaaaattttctcagatttcatttgctcagttttatacctattgatctttcattttaattttatctaaaaacctttcagttttgcagtgtgtcacaagtctgtgtaagctgcagcttcagccatctcttccatgcaatgtcaatcttgggtcgtgtgaagcatgtggctttttggaaattttctaagtaatgtaattgatgcaaaaaaatcaaggatatatattttcaatagccaagataatagatacataatcctttcaattaaaatttgtgttaattcaaggaagggtaggatcagcatatatattatgtgtttatcaagaatactctcctgagaaaattcatgaaatgagaagtaacagggagaaagttgaaacattgctataacatatcaaaatgagaggctctgcataaatgaatttataagaaaacattaaaattgccaagtataaagactttacagatacagagttaatattacctttatgtagacatttgaggcttggccaggctctcctcaatgagtctattttaaggtaaagttattaaagtccggctcccatctcacagatattatttgaagttgttttatgtggaagcagcctgcctcatgtgattgcactgtgaagctctccagctagaaggcggctatgtgacttgaaatttaaatataaagcaaattcagtcaggtgccaaggtgccagcctgctggaccaccatattgggaggaaggagaagtggagggcagggggttgaatggagattgggttgtgcgaaagagaagatttcaaactttggggctggaagagcacagggtgctgcaagaagcaatgtgttgggctgaataattcatgatgcagtactaattttgactctggagaaaattgctttctcactgtgccaaaagctaggcagtgagaccaaaaatcaaagaggaagctaaatggaggggagaaaacaccctaaatcaacaccatatcaaattgacaaactgtttaaggctgcaaaatgtattgtcaaaacatgtgagtagatattttaaaccttacctaaaattgagcatatttatgcctacttattttgagcaataataggtagatattaaataattattttcaaaagtagctccttgatattaatgcagagagttccagtaaggaagtaagcatttgcatttcattggaacttggtaaaaaaaaaaaaaaaggctgcatatcttggtatagtgtaagagatccatcatcattttgtacttacagaatcatatgggtgccagaaatgaccttttgagctaattaacagagctgccataaatatggaacttgataaatgttaatatttattggattcctaaaatccagatggtcttccttgtcttttcattctctttggaagataatattaaaataagaaccttctaaaatgcaaccttaggcatcttttcaaagtctcatttaattcttttctttaatggttaggaggacttatgagcatttctgaggaaaagtcgctgactgcctcttaagccttaaccaagctttaaactttagggatttccactcagatttaacaacattgagaattttggtcctagatttctttttctttaaagagttctttaaagagttaaagaaacttctgggcaggaaaatacaggaagcttagaatgaagatggttgaggtgttgtcttcctcctcttctttcattttgtttgttttgctttcaagagaaaagccagatacagctctggggagtcgaaaggcatccttggcaaagaatgcaatccctccagaggctgaataagcgtgcacaggatgaactcacagatagccacgccagtctcccagagcagagctgcatttccaaaaattcactttctggcaaagatgaggattttcctgtagtggtttgcattgctgaatggggctgaagaaacaccagtcttcaggactatttggaaattatagttaacaaaatctagagagccatgagcaatccaaagtaaaattcagttgagtgtgtagagccttccacatgagagggcatggtatgtaatttgcttcacttaatacagattttggagacagggcagcaggctggtgcacagggcatattttagagggaccataacacacccctatactagaaatgcagtgtactgtgtctcctcactagaaacctaaatacagcctctgaaaggcttgtcccttgggtgacaaagattgctgaggtttgatggagtgctgtgctctcagtatggagtagggggtggtggaaacaggaggcatatattttagttctaggacctccctacatttacgagttctttgactttggaccaagtcatttcagtttgcttggctttcttttcctcatatgtaaaatgatcattttatgttagtttgaaccatgggaaatagctgatatttgactaacctataaaaacagcaatttcacatggttcaaactaataaatgctcttgagacttgttctgaggagcaaagaagcacctcgttgtagataaacacatgcatgtaaattgtgtcctcttcctgctccagttacatcatctattgaacattttgtggagtttcaatgagataatatttggaaagcaaatagtagcactcaataaaagtcagtttctctcatcatgattccacacactttaatttcaactactgttttgaacttaacacttctccagtgttttacaatttacaaagtgctttcgcataagttaactgtttatgtgatttttgcaacccagtgataagacaatgaaagttccaaaaaagttgtcacttggactgaattatccagataggtagtaggatattgcacgtcgctgagtacaacatatggtcattgcccaataccgatgtctctaaattaataaaggcaaagtgggcatgtaggcatgtcactatctagtctactaatcagaaacagatcagtggtctttaaatattttgatcacacaactttttatgtgataatatttgaaacattaatatatgtgccatttatctatttagtatacattttcagtctctataaattatatatgcatggcagatgtaacatctgatgtgcattatgaaacatacgtaagtaaaaccttttaaaggaaaatatttaaaaagtaaatatattgcaagtcctaatattttctccctgcattccaaaggattgcacaattgcagctttttaaattgagatgcaattagcacagactggtggatttctatggtctttattgcccaggccctactttcggttcccaggaacaagaaagttttgggatttgtgatcaagtcagaccagcttccaagcttagtgaagctagaacataagcatgcagcttataagggaggacccaggtagagtggtaatgagagccttacttgtagtcagagcacttactatccaaaactgtggcctcatgcagggcacaagcaccctcaacctcaatttctaatacgggtttatttgaggagtagaaaagaataaaatacaggttgaacatctgtaatctgaaaatctaaatctgaaatttttcaaaactataaactttttgagttctggcatgatatcacaagttgaaaatcccacatctgacctcatagtcaaaacacagtcaaaactttgtttcatgcacaataaatattacataaaattatcttctagattttgtgtataaggtggatatgaaacaaaagtgaattctgtgtttagacttcagtctcatcctcaagatattatgtatgtgtatatattccaaaattcaaaaggaaatccaaaatctgaaacacttgtactctgaagcatgttagataaatgatatggaacctcaacctgtattctattgaaagcacttgctaatctataatatactataaaatataaggtattatcaatgtgtttatgtttactgtgtatcccagcattttaaatactgtaggcacacagcatgagtttaatgaatgaatgagcaaaaacattaattaattaaaaataatacattaccttactatgtcacatatgctatttccagaaacagaagacacaacaaaatatgttttcaaagcaagtttttttgttttgttatcattttatataataggaatctggaggtaagtagcaccagagtcggcttattcgactgctcaaacccattggtaagaaccctggttctgtctgtcttccactgagccacgtggaggcactgggctctttctctttggctagatctactgaatttctcagacgctgccacagttccaagcagctatgaagatggcagtgtctggaggcattggaaagggaacattctgttctgacaaagtgtttttttaaaagaaaagaggccaaatattcactgagactcccttccccttaggctcagtggctggtagtatgtcgtagcccattatttcactagtccaggacaaaagcaatgatgctaataggatttctttatcttgagtttcatgtcttagggttggagaagggaccaagcctcccctgaaagctgaggggtttatggtcaagaagaaagagtaactatggccacctttaggtcaccagccaataatactgcttctctatcctgttctgctgtgacatttgtcccagcaggtgttccagtctgtcctacagtagtgagaccacctgatatggtgaggaaggcaggtaattgatcttactccatcatatcatcacatctatttccaccccccgcccttggagacaaggtctcactccatcatttaggccggaatgcagtggtgcaatcatagctcattgtagtctcaaacacctgggcccaagtgatcctcactgtagtctcccaagtagctaggactacaggcacatgccaccacacctggctaattaaaaaaaattttttttgcacagagatgggggtcttgatatgttgcccaggctggtctggaactcctggccacaagtgatcctcccacctcagcctcccaaagcactgggattactgttgtgagccaccatgaccagccccatcacttcttttgtaggtttgtatttgtttttatttttgacaaagacttttatttcacggtgacttcttcacaagtttcctcagatgctagtctgaacaaaggagagcagggaactagaaatgtagactttctgttttttccagctatggcatcactgatctcatccatcttactaaagtttgtgcagtcttgatcattccccattcccccaacatgatggcaaataccagttaagtactcatatctaaagaaatcctttattaacaggaagttaattaagaacatgtacatctctgacattcatcattacaatgagtagaaattaattttttcaatttcagttaaattttattcagcaaaaagctttaacctcttataataagatgtgaagaattatgagaaattatttgctgtatttctggaacgaatgcatttaataataggtcagatgagcaaaaatggttgtaattcaaatttgaatagagaatttcttcggtgatagcaaatggaacaatatggcttttataagtaatattttgattttaaattatttaaaatattcagatgctattctagttttaatccactttttgctttctttcccagcatcctctgaaagtttatatgctagaggtctctccttcagccactccttgatcatctccaattagaaatctatttatttttcatcagaaatgatcaatgctacaagtctgattaatatgagtggtgtgtatatgtgtgtgtgtgcacatgaattttagacagttttctgcagaatcatcttctgttactatttttcaagacaatactatgacaagccaatgtgttctgaataaattatgcaatcgatgggtgaagcaggcatttgctttccagtattatacatcccaacttgtatcacacaggcagacttctgttgacaacactattgacctatatatgaaactttgaaactctgttttacatttacaaaatttgatatttctgatattctatgggcttcactttttgacatcatgcctttgtacttttatgcaatttgataattatattcagccctttataaatagttaaaataatgtttaatcatctatggtaaatgtgtaaattccttactacacactttctgattttgtgtgtgatttgtcaggaaaaattcgtggtttgtttatattttttatgttttccttttttttttttttttttttttgagacagaatttctctcttttgcccaggctggagtgcaatggcgcgatctcggctcactgcaacctccgcctcccaggttcaagcgattctcctgcctcagcctcccaagtagagtagctaggattacaggcacacactgcacactgccactactggctaatttttggtatttttagcagagacagggtttcaccatgttggccaggctggtcttgaactcctgacctcaggtgatccacctgcctcggcctcccaaagtgctgggattacatgcacgaaccactgcgcctggcctttttttttatgttttctacacaagaccagattatattttttagaactaaggaaaaggagcacttagaaagtgtggaaaatcaatgaccttgcaatttgatatatactctggagtatactctgaaatctcaatagtttacagacaagatagtagaaattagaaaatacattttatatatatgtgtgtgtgtgtgtgtgtgtgtatgtgtctctatctatacatatacacacacatatatgcacatatatgtgtgtgtgtacacatatgtatacatatgtatgtatatatctgggtgtgtgtgtgtgtgtgtgtgtatagatatatatagatatatatatatatatacccttgtgctaagggatatattttctaatatgtattcatgtatttttataaatcttaaattttcttcagtctcatagctacagactctgtaatgttttttgttaaactgaaaataatcatctctggtgaatctttctaaactgtgtatttctaaatgtttttaccagtattattgtgtttttggaatcacattactttttagtgtagtgatagcaagtatagcgagttaatgctttttttaaattagcaaattaatgtgaagatcagatctcaaatatcaggttgtctgatcttattcagtatgccatttggcttaagaagttctcattttgtttctgcagttcactcatactgagcaaatctagacaaaacaaatcctgttgctcacttggaatttagataattgtttcacaattcaaagaaagaagttaattagcatgactttttttcaattaaaagttatttattaaattttctttcctgaaactgttcatttcctaggaaggtctagaatggaacaaatataaaactaagaaacagcagcttttactccatgtgacaaggttttgttgagggtgcctgtggggctggccatatttgtcatgtgtgtaatgtggctgtgcctctggcaagctgtaagctggtagttagtgtggagtctgcattccagctacctgggtgccatcgctcttaacacacttcttagctcagatgttccaatatttgttctcctgacctacaacattaggaccacgtgggaacttgctagattctgaggctccctcccagactttctaaattagatactctgagggtgaggcccagaatctgtgttttaatgtgctcttgaggttattctgattccacctaatgcttgagaagcactgccctagcttctgtcttgggcaacactcctgaatcagtgcctagcttttcccagctgtaaaatgtaaaatacaacatttttctcgtagaattattgtgataattcaagaaaatcatgtaaagttatttctgcaatagttgcctaacagatagagtgctctaaggacactgagcgttcttcaaaagcagtatggcctgtgtgctcccatgtctgagcacatttgaaaaccagcctctaaaattacacttcctcctctatcaatgattgcagaatcgaatgttgcaaatgcatggcagtaatacatcctttgaagaatgaagtgttattaaaatttcattccataatatttgtattagttttgtattactcaaaaggcctatcttattttactttcttaatgaaattaatttttatttcactatgaatatttttttctagcccctactttcatttccaaattttctcattttctttttagtctggatatttcctagataatttatttcaacattctagtactgtataatctcaaatacccaaagaaaatacattttttgaaatattgatgaactaaaaccaataggtatgaatgagtcgatcctgtgtttaatctacatgtgagatatcacctattctattccatgcaaataggaaggtaaatatgatgaagtcattaataataacgaaataaggctattttatataagaatttaggttatgtcccatacaaattaacagcataatattacgtgattagtcttcctgatactaatattttcctaatttattcttttcaccagctgcattaaaattcaccgcaaagattcagtccaaggttctcacagggaactaaaggttaaaatgtgtttgttagccaatatacaagactctgtaatcttatatactacattggcagggactgttgggattcagttctgttcagccatggaggacacactctgtgttgccctgagactgtggaaaatacagcgtctataacatatccccttcttacagaggtatgcatctttgaactcagaactctcctttgctactctcattcaagacactgtacagcccagaacttccagcctgtgggtttttctcaccccctttctctgcctgagccctctgctcagggtgggattttcatgatctccccacatatctttcttcttctgtctctgcttttcctctcttcccaaagctagaaagccatctcctagcttaattaccacctcccatgatcttgtctatttgttgctattaatctgaccttaataaaagtgtttcctgagatttcaccttatggacatttggattcaaagtaagggctagaaatggagagttagacgaaggatagatgagctgattgcatctagggaagtcaaggagttgggcttgcattgcagagaatggctaagaaaggagaccaatctatgggatacttaaaaaacctattaaatctgaatatctgagtttgtccattattagaattctttcactaagtgcttcttaaaatgatcaaagaaacgtttgggattgtgagaaaaacagaaacattgtcctgtgcatatattaagtgtgctatatcaaataatatttcatctttagccatcagtaacacatttgttcttagtatatatatgtcaatctaaaaagggtttctcaaccttaacattattaaatttttaggttaaatattgttttgtttgggtgtgggccgccctggcattgcagcttctctagcctctacatactagatgctggtagctatgtgacccctcaaaaaaattttttggcaataaaaaatatcttcagacattgtcagatgtcttctggggggcgtagtcatccaaactcgagattcgctggtccagactgtaaaaattatcaaactactcttgggaaagatgaatctattttaagatccacttgcaagctacatctacataaatgtccattaacctttagtactttgtgacctgattttgtgtttcttcttgcatgattattttttgggccctcaatatatatttgttaattctatttcttcagtttctctagatgctttatctggccaaatagtgtatcatagcaaattagttctagaacctcacttgtcttaatattagttaattggaattaatatttgttaattctatttctttcatttttctagatgccttatctcgccaaatagtgtatcctggcaaattagttctagattctcaatagtcttattattcgtaggtacacaatagtccaatgcattaaaatgactttccttttaatagttctacgtgaataaaaatgtatttcctggcaaatttcacctcaatgctgcaaatccattgaaaaagggaataatacagtatcacgatacagggagaaaaacttagaaacacaataagatatacatacacacaactttacgagagtaaataataagtaaagatatatatgtatacacacacacatatactgatacagatcactgcaagaaaatcacaaataccaaagtcaaccagaagacgtgagtagagaaaaatagacaacaaaacaacaaataatgcaaattaaagtgagataatcattttgctgtcaagataggagaaaaaccaagagtgggaagatattatgattcttcaatcatgtgggcatgtatctttactgtgtgtgtgtgtgtgtgtgtgtgtttatctgctgagggcctttgaatactctttccttgctcagaacaaatagacaaatatataattaaggcacctaacaatacagaccatattttcagggatatagcaactaaaaggtcttaggaaggccaactcaaatccaagcacatggattccagctggggacaggagtgaaaggagtggatttcttgtgtctgtgagcctagagtgaaaaacagcttcaggaaaccttcactttgttatgtatgggatgaaattgaaatcaagtgtattgtgttagggggatcctacaggaagaagatctgggagatttttcttgaggtttgggggcaggcatttagctgagggtggacattgaggagaatctggagggcttttattagaaatatgcttccataccttgcaaaaaactccaaaatatcacacctgtttctcaataccacatgctttgtacatgccatataactatttttgattaccaaatttcattttgagttttgatactagttttaaaattacagttatagctgagcatcatagcctgtagtcctagctactagggagacagaggcaagaggcttacaacacaagcctggacaacatagtgaaatcctatctctacaaaaaaatatttaaaaattagtcaggaatgatgacttgtgcttgcagttccagctgcttcagaggattgcttgagcccaggagttggatgctgcagtgagctatgatcataccatcacatgccagcctgggtgacagaagaagacactattgtctcaaaaaataaaacaacagttgttcaggatcattaggaatatatttaatcaatgctttttcagaaatggtggtttaaaaataagtaggctaggaaggaagtcctaagtaggtattctggtctcagacttgtgcttcctgcaacacctttaatatctataaaataattagagtttttgattgtggagtaggcttgatttggaactgaggatttttttctagacatatattttaatttgagtttcactcactgccaaaaaaaaaaattggcaagacagagaaagaggaaaaaaaaaaaacaggccacaaaatgtaaaagtcaaaagcagtcattccaaatttgtgtcttatatattctctcagactttgctgtcttctttatgtttcaacatttttcagatagcatcattaatgaacagccttccagcccccctccataatgcagctttttgatcctagtgcccaactggcttcaatcaattcctctgaccatgcagtttatgactctacaaaacctgccaggactcgtttccttagtattagatgcaggcaggtagaaattgagagatgattccacataatgctcatcaaagcagaaaaaaatcaaacctaatgcacaacagggttacaaagagaaaaagttaagcagtctgtattaaaaacaaaaggaaataacagggacagaagaaaaagagaaaataaaacaagtgatttcatgtaggtgctatagaatctttaaccaaaccacaggctctgatgaatgatctcttctgcctgagactcaggactgtcatggtccttatgtccaggaaaagagccagctcttttattgagttgccaagagttgtcactgaagccatcctgaagtttccttgcttctagttagataggaagagaaacacaaatacattctccctcgggacggacacttccaaactaaccactcccatccagtggtaacctactcccaaatcctccaggtggcctactacaccctgctttcttctgcttgcagttgcctgacatgacattgctcaccctttcttcttgtaagtgttacctttttctgtgtccctttgttatagatgtttggcctatagtggaagggccttacatttgtgtcacataaatcatgtcatgttattcagcccattacattttatgtcaagtaataccttatggtattttacctttatcaatataaaacaaatttcttttgttttaagtttttgccctaaacttcaatattatctggtgatggagtggtaaacaggctcttcattcatggagcttataatctagtgtgagtaatagaatagaacaatttcttaaataaatcaggagttaacgccgattgtgatgagaactcaggagaagtgtaaggtatgttggaaacaaggagcataagttggatgagcgatttagacaagtattccatatgggacagacagttctgcctgtctgaaggacacaaaggatgtaccaaggttatgtttctagacccagttgattagacccctgggtttctgctcttgagacattgccagaggccaaattaggccaagtccctgggtgtgtttgcctcctgtagggcatttctaaaaccaattactaccttcagatcaagaacattttctcttataacatctcttgaattgtttgggttctccttttaagaataacaagtcatccctgcaagctctttattttctgttctctgtatccaccgtgttttccctatttttgtttctttgttcttttcttctgaattctaggtagacttaagttggtcttccaaattgttggcatcaatctggctcttcagtgccccaatgtggatttctagtatgattttccgtggtaattttctgtatgtcacatatactttttacatcctaatatgtggctttattttcctgtcctgttctcttcattttgcttttggctagcttgtatagaaacatgttatttttgcatttgtatggaagtcatgttgcttttgaattgtaacaaaattgaaattttcttctggatcctgcagtagattagcagaaaatcttctttttgagaaacttaagtatttcctctcaggatttcttcagttagcaattcactaggaaacagaacccgaaacaattctttcagtgtagattctttattgaaaggcaatgcatgggacagccagaacaaccctgtctactccaaaggggagaacagtcagacgtgcctgcagccagccccagcagctgcagctggaatgccggagagccaaccaagggtctagaacatggataaagctgagataatctcagggtgtgtgtgttactttgaatgtatcagagtacttaatttctcaaaaaaacatatcacaagacaggctgtctgttcatataggtaatagtctgcaccctagatctgtatttggaagaagcttttctacaactgcaggccaattgctattcctggtgggtatttactaactcacttctgcttcaccttggccgcttttccccctggcctatcaactcagttggagagaatcagaactggacattttgaacaatggaaaaaattgatttcctcctaaatatactactagggtttttgctgcctttgtgcactcagaatgcagtgtagtaatattccagcaaccaccccaaacacacacacacacacacacacacacacacacacacacacatacacaccacccacgttcttctggatgccccactaacatatacaggcacacacttcacagacacacactccacgtgttctgcctaatttcttggtattcttttctcttataaatgtagtcaactagcaggagggcaggaataccaaggaaaaggaaccagaattctggcgcttccagaaagcagcaccttagggctataggcacagctattattttttggccagatcacaacctgtaagagatacaaagtgagtctgtttccttttctacataacctctgtcttatcatgacagaaaatgttgccggattctgggccaaagtatgaaacagcatcagaaaagccagttgtgtcatctatccagggatgccaccatgtgagaacaaggtcccctaatattctagagtgcctggcctccatgcagggacaattgtgtatttatttacaagaatgtgagcaccaacactgcagagtttaggcatttatgttcattgccgtatcctcagcacttacaacagagcctggattctaggaggtggctaatactttattttggtgaaatatttgattagagcagttatgtgattattggctgtcttcccctagactaggagttccctgaaggcagcactatactcttttctttgccaggttatcttctgcttcaggtacagcatctagaacataaaaagtaaatacatatcattttatgaataaaaaagcacttttagaatgcagaaagcagaatgactagtagtatagctgtgttcatgtctgcccctcaaataaactaagtgacctgacgatagtgactcttgtattcatctttgaacttctgacaaacccagcacaattcttttaagtaagtccttgcttactaattatttggttgaataagcaaacaaatggaaacatccataatattagcaaatatgatgcaagacatgaaaagccttatgcattgaaatctacatgacttaaccctagaaggctgaagtgataccacaccaggaaaattactaacttaacagaacacatcaaaataaaacattgttcaaatctatataattatctcaattgccaaaaaagtatctgataaaaattcaatagctattcatcataagcacagtaaaaatcataggaaagagggtttcttttttcacaggggaaaaattaaatgtttcaacaagcattacctttaatgtagaaatatgagactttctaaaacaaacaagaataatatgaacatagctcactttaccattgctgctacaattatttattattttaatagtaaaattattaaatattaaggaaaagaatattaaaaataaaatcaccagacctcacaatattcagtatacttttaaaaatgaacttgcaggaaaattgttgtttcaaatgtgtttactaggaagaaaaaaatgcaattatgtaggattatgattaagaccacaaaagataagtaaaaatgatacattaaatgctaatgtggggaaatagaagacaaaagagatgcatgttaaaaaattacaagttctaactacggtattaacacctaaaatcagttgaatatcatttgcaaggaaagaatatcgtttctttaaaaaacatatgctactttttctgttattaccactagaagctacattaattagacactgacatataataggatagactctaagtataaattatttctcatgcacatagcaccttgattggtagatattattgtcttctttcttccaggtaaaagtagagggtgagaggatgctcagcaggtggaggaaatataccaagccagggcacaggtttggttctgaatgaagggcatgttaccctacaacagtatgaacaagaaaacatgagtaacacaaaagcactagatgaacatatacacaagcgaacatcctcacacacaaacatctagtacaaataattaaactcagagtaattatcagtgtgattatgagaaagagataactcatgtcccacacagatgtaattaactatgtgcaaggcattgagtaaggtcttaggatattcctcaggtttggaatccccttcctgcattttcacttgttaaaataaaatcaccaaggaatatttacagtggaatatttgagagaaagtttgtatatagtttatttagtgttatttgtgttttaattctactttagtgttttgttgaagtatattaagatcacgtggcatatttctgtcataatgtcatttagtaagctctctccatacccgtttcttctacgttattaattttcttgtcgagacttgtattacttttttattgttgtttgttccacttaaaatagggccattttagtatctccaaaaacaatactatttctaattttcttacattttaccccaagaatctatccatatattactcaaaaaattgaaaaaaggcaaacttccaaacaacatgttaaggaaataaacacacttcagcatccagttttccctaaaggagaagcaattactcctgggatactaaatgagatttgtctgtggctcctctttgagaccagttttcctcaccagggatgacttattcatttgtacatcaaggaattctcagctttcttaccacttctagaagctggggacatttgatcatgtgtaggactccttacatttctgaaacacatctcagaaaagcaggtatagctaagccaacattttagaagtgcagaaaggcattttctggaggcacaccctccaatgctgcttttggagtccttgtgagattttgatttgaatcctccttctgtacctattagctatttgaacactgatgaggtactaaacctctatgaaccctaagtttttgtttattatattaaaaataatgctagcccttatatcctagaattgtgaggataattattagcaggtcatatgatagcaaatattgactgggttcttaacacacttcaggcattgtgcatgctatatgtttgaatccatctttgtatttaatgctaaccactctatgaaatagttgttatttatctccatttataactaggaaactgagattcaaattgctcatgtaatttggccaaagtctcacagttagttgtccagattcaaattccccatctattggactcatagtctctatacttccaggatggttttcacacctattcagtgctcaataattgtcagtcatcactgttgttattattgggagaactttgaaacacatttcccagaaactctcaattgacaaatgtggagccaagtctcttttcaagataggaaatttgtcttgtcttttctgtatatgtgctataacatattgcttgccttcttgtgaatccactaagagtcacatgttggcggtatgtatgacatgttcatgtctgtctcctttgtcaggtctctcatggtccagacatgagaaggtcatctttccttattcttcttcctcatttccacccactgcagcttgtacttgggctgtttgtatcttggtaagtgcaggagcgcttcagttcatcatcactgctgctttttcctctttccacatactggatcttgcattaatgactttaaatttggaaccattcattctactgtggctgttgggctttctctgtctttatagagtctcattgcaggaatacttactaagctcctgaaaactgacacacccttgcatttgacaactggctcattattattattattattattttattgtatcatttattgattttgaacttgatgctgggtttgattaagggaaaaaacttaaagggtttttcttttttaacttgcttatcttttgaccttatatctaatttcatctcatgacaaagaagagacatgaaatgtatttgaggtggtacactgatgattccatctgaatattgctttgtcattgttttgattagaaacaataaatggtgttgacaaactctgggaatgatttttataatgaaagagaatagtgaaagtggagaagtttcaataaatgatttttaaataaaatgcttttcttgaatataaaaaacatggtgttggcagatgacattgtaggaaatattactccaagatagactggtaagccttttaccctttccacttctctgtcacttcttgtctttctagaacatctcattactttcctttatgaattcttcccccaaggctctggtgttaggggcagccttcattttccatttcagttcaagggacttaccacttaatttaagtttcctcaagtctgaccctcaactccaaagttccactcatcatttcactttttagagcagagatcacctgcatgatagtgtacctattgatggtccctgatgtttcagaggcccctacttgtatattcagatgagaatatcaacagggccttcctcacataactgtaggaaaaggtcaaaacccagaccccatagagagacctgggacacttctaatttatgaatgcaatttttaaaaagatttaaaaattaaatgctatgacacaaaatacaatacaataggagtgagtgattcacaagatagtatgagtatatataaacataaatttatgtgggtgttgtagagttgaattcaagttcaaatttggggctttttgtaaatgtgagtcacagattaatttctgacatattgtacccctcattagggatacagcattatgataaatttctaagagaaaaataactaaatcacattgtggtcatgtttttagtgggaataaaacttaacctagaagagaaagcatgtaatgcttcattcaaatatgatattgatttgctgtgtggccatggataaacaacataacttcccaggacttttttcattttttttttattggggatagtattagttaccacattgaatgtaactggatatggtgtaaggacaaattaatttgtagatatgaaatatatttgaactataaaagacttttggacttaaaatggtaatgatgatacagccccctttcctcatgaaaattaatttaaaataactagaaggaaattcaacctttattgaaaagaatctttggccaaatactggaagaaaggctccagagcccagtatgccatttcagaagtagatggtatgcccttctgagaaaacaatctcttatttgcaacaatgcactctgtggcaagtgcatgcctggaagccactgaacgtgatgaagcaactggagggtcggaggctgagtcaggagacattgagacttaccacttgtatgaaaggagtcagacagtgaagcaagcttcaagggaaactccttcggaagcagtcctgagtgacatctctctctcgcctggggagaattaaaggctaaactagatataggaatacactttaatgcatttcatggtcagcctctgacaattactgttgtgctatatcccactctgaccctcctcccatagttccaagtactcactatattcaaaggtaaattaccagcatatagtctatgaagactcaccatgtgtaaaagggaccattgcagcataaataccaaggtattaaaataattagaatagaaagcagaatagaaagcagttgaaaaatattcaccagaaaaattttgtcatggagaaaatgaaattaattcccaaatgtattactaaattaagcaatagacattaacaaaacaataacttctttgaaataatgtctcaaagcagacatttgggaaacagaaattcaggaagaaatatagcaaggaaatagaaggaaatgactgttaagcagataaaacaagaaaattagtatattagtttgttctcatgctgctataaagaactacccaagactgggtaatttataaaggaaagaggtttaattgactcacagttctgcattgcttgggaggcctcaggaaacttacaatcatggcagaagaggaaacaaccatgtccttcttcacatggcagcaggagagagaagtgcagagcgaagcagggaaaagccccttataaaaccatcagatcttgtgagaactcactcagtagcacaagcacaacatgggggaaactgcccccatgatctaaccacctcccatgaggattacaattcaagttgagattttagttgaggacacaggcaaaccatattaagtataggaaagaatagtagaaaagaatgttacatccaaagttacattggaaataacctaaaggagaatagaaacggaaaatatcaaaaagcatgtgaacagtgaaaaaatgaaacaaaataaattaacagtgagttaaaacaattgtcaggatagatgaaaataatctgttagaaaatccaaacagaaaaaagaaaagttcagcatatgcataagtggtgtgcctgaaaaggagaaacgaatatatggagaaaaaaaatgtttaaagttactttttccagatgtgaagaagttttgagaataaacatttttgacttttaatcttttgtttggaagcccaacattatgaaaaaaattatgcaaaatgatcaccgtcaatatcctaatccacttaccttttaaaacacagtcatccgttggtatcttcaagagattagttccagggctcccagaagataccagaattcactgatgctcaggttctttggggtatgtattcagaaaccaccaatatagaaggccaactagaacagggaatcttttggggagtctgaaaggagatcaaatcctaaacaaagggtgacttcagaattcctctcagtaacattccacattaggaaaagaacaggtcaatgcctttccagtgttttcaggaaaaggcagtgtaacccatgttcctagactcagtgaatgtatcttttaaagtaaggcaactgacaaacagttttcaacatgaaatactgctcagaatctagttgccagattcctttaaaaatattctgacaatgaaaatgaatagaggaattacagcaaaagaactgttgataaacattaaatatgttgaaaatattaaatatttctatctgcattgataagtaaaaatatttctgagaattatgtttacagaacagaatgaaaatgttacaaagaataataacattgaaataatttatctgatacaatttaggatgaaaagtggaagagaaggtgagaggtggtatgcatatggtgaattcttcatcttttatagctgaaggcaaaaaaatgccactcaatggtgatttattaaataacatagcataaacatgcaaaggcataaaaatgtagtaaaagtgtgtaaacaattaaaattagataatgcagtaagagaagtgattggagactaagtggaggtataaattttgtcagtattacagtgaatggtcagtagataataaagaaatgtaggattataaatattatattggccaggcacagtggctcatgcctgtaatcccaggactttgggaggccgaggagggtggatcacctaaggtcaggagttcgagaccagcctggccaatatggtgaaaccccgtctctactaaaaatacaaaaattagccaggcatggtggcaggtgcccgtaatcccatctgttcgggaggctgaggcaggagaatcacttgaacctaggaaggttcaagtgaggttgcagtgagccatgattgtgccattgcactccaggctgggtgacaagagcgagactccgtctcaaaaaaataagaaataaaaaaatatcacattgtatttaaaaggtaacaaaaaaggtaatagaaaaacatgagaccttcagattattaatagtaacacaaacaggcacaaaaagaacaaagtgaaatattgaaaaaaaaaacctagtattatcatgaggcatactgaaacacaatataactaattctgaaaatatctaccatattaataaacgcattatttatcaaattttaataagaaagttatttccacaagaaatcaataggaatggatatctgtgcatcacataacatagactcacattccataatggaaaatctacagaaatttcagggcaaaagagaagaaaacatattagttgcaggagacataattcagtgtgtgaaaactgtcagtaaaaattagtaagcaaatagaagaccactaaaacatgattgatttcaaaatgttacatatcattgtgtttttctccattaaagatatgtcttcataaattctctaaaatttttagttaaacagttttctcttaaattggattaatagtttctgaattaagaacatttaaaaaatatctttaagaaactgctttcaactttatctttcaagtttttggctactcacacttagtcttcactgactcctacatgaactgaaactctaagcataggactaagagcaagtattataaatttgaaggcccatttgcaaattactatggtaggtctctcagttttgcaaagaatcagatgttcagttggctgggaggatatagaaaggaaaaatagagtcccttctctcaaaacccccaagtccagcagggaaaacacaccttatatatcataataaatagaatatgcaagataagctccagtgtatgcagggggaaagggactttggtggaagcagctaaaaggatcttgtaaaaatataaattaacgtcttatgatgcaagaatccagcctgttttaacatggattggatgacttgcttatcagagacttggaacaaaaaatagtggatatggatcacaagttttctgtgatctttggaggaagaatatgacaaaatcctgtatgttgtccttgggataccctcctgacatccccactccctctgtgttgcttgtgcttacagtagagatggctcttctcctaacaggtgctcctcaaattccagatctcattttgctgtcttctctcaggtacctcagacttctgaccgtttttctggttactaatacagactttcattgtttttctcttttgctgcatctataaatattatgatttgtcagaaattttgttttgtatacatttatgagacaatcggccagatggggctacaagaggagacacaggagagactcgagaaaataaagtattttctactcacaggtcctagagacaggaggcatgccatacatggcaacatggggaagaccagagtggtcaggaggcagaaacaggagcaaggtaagttgtaaggcatggcctttgttggggtttctgagagaagggtaaggcaggataggatgaacagtttaggactactttgaataatttctccagaatttgggaaacaggagtgttctctagttgcctggtacctggccctgggttgcttaagacagaagaatattgtttccagggtatgtgggcaaggtagaggaaatgtggctctgggttggttagtttgcgtgcttcaggctggtccctttcctatcttaagtattggcggctgttcgcagtggctcacgcctgtaatcccagcacttcgggaggccgaggcaggcggatcacgaggtcaggagatcaagaccatcctggctaacacggtgaaactccgtctctactaaaaatacaaaaaaattagccgggcatggtggtaggcacctgtagtcccagctaatggggaggctgaagcaggagaatggtgtgtacccgggaggcggagcttgcagtgacccaagatggcgccactgcactccagcctgggcgacagagcgagactccatctcaaaaacaaaacaaaacaaaacaaaaaaagaattggctagcctcaagcaaaggtgatctcttccccagttagaaagattttctaagatatcaaaacatcacaaggtacagaaaatttaaatatacatttatctacaatacagccttgttctgggccttcttttccctcactttctttctatcatgactttcaatccagtagcctaaaatgccatctatcttctaatgacttgcctgagattcactcttgtgtatctaactgcctctttgccccatgaattttcagatatgtccaaaacatacctcttggttctcctccccactcttgcttctccctcagtcttccctttcaagataaatggcaccatcagccaaccaggaggtcaaaccagaaaccattggcttctttaattccattactcttcccttcctatcccacaagcacctacttacacccacatttaagaaccttttaaccatctactcatccacaaaacttagttcttccttcaacagaaatctcaaattcagcaacttccctacacttctgctgccactgccactatcaccctgcaccaagcaagccgctttcatcttaccccttttctgtcacagtatccccccatcatattctccacatttatactcctagctgctctacaaaccatttttgattaatattggtaaaacaaacgacaatcactccccggctcaaaaccattctcattgatttctagctgtattcaggatgaaacatgcaaaccttaccagggtccaaatgccttcctagcataacctgttcacttctctggtttttccaacataatttttttcactcttctttctcccccaactcactacgctccaataccaatggtcttttatcagtttctggaacgtgttcctggtcttgatttaaaggaaatgtaattaaataaagatctccatagaaacactgtctctgtctactctgtctaaattattcccttcctatggtattttccatttcagcagtttgtctgtttccttcaaagcagctgatcacagttgcgattacatttacttgtgaccttattttgtgttttgtcatctggacgttatgttccaggagagtagggataatatgaatggttttctcaccatcagatctccagttcaatcacagagtaataacattataggcaatcaagggtagacacatgcaggacatacccaataaataattgttgaatgaatgatttaagttcaatttgttacaatattttattcaaaatagagcaatcattattaacaaaacatgaaagagaaaaatgagagagagctacagcagggacagcatcgtaaaagttaactgggatttgggcttctattagtggcttcagctcactaagatctttataccaagtcaagtcaggagaggctggagagagagctgagaaggctggctgacaaggctgtctacactccaccttacctgccatggttgtgaccatgctatgcagcgggtctccactgataactttcttccttcagccgtgcttgccttgttactgtgtaatcgggatgtgtttgtatttcttattttggcagaaacactcaagagaaggggcttcattttagtctcaacttacaactgctctctccaataatttttgtgtgtgacatatcctaattaggctcagtgtcttcctgcattcccagcaacttgagtgacagatcattctattaaatttggggagcaatgagactagggcaggggttggccagcaatggcctgaagtccagatccagcctgccagttgtttttgtaagcaacaaattttttggaacacagctgcaccctttcatgtacgtatcattcatgactgccttcctgcaaaaatattagtactgagttgatggatattgatggtggagttcacaaagctgaaaaataacttactatctgcccctttacaggaaaagtttgccaatgtctggactagagtatgaacttctttattctgagccttagatacagtattagaatagtttaactatttttctaacatctctatttatacattattaattaatttcagggaaaattggattttgtttacatcttccaatatcatttagttcagactctattatgttccaggcatttacttaatcgataaagaaagctttttgtgacctttccatctcaagtaatctcccactgctcttaaggcctatattgttttgccaccctagcactttatctctcatagagctctatctcacctggtgctttatctcccgtagcacacagcattttgaccttgtatgtgaatcatacgtgtgcatggctaatctagcctactagtgtggcattgtgtaaagaaaattgtattttgagaatgacagattgctaggctctgagctgcatactagttgggattctgcctcttttgctgacctggaaagttgtccagcgtgtgtcacttggtagacgttttatcatgcatgaatgagtccgcattatgcctctatattaatagagacttgcctccttgatttttgtagatcacagtagaactggatctacaatgaacattatttagcatggcccatccctgccacacacacacatagacacgcacacacacacagacacagacacacacacacatacatacacacacacacccctcactctcactggtgtcttgtgtccactgtttctaatcattaaatagaggataggtttggacactgtacttttacagtcagtcgttagaatcctaactctgtcatttattgagggactttgaacaagatacaaaagatgacctttaatttcctcatcttttaaatgtagctaatcacagccaccttccagtactgtagtaggaagtaaatgagatagcaagcacaactggaaggagctggcatagctcataactcactgtaagtggtcagtagaggtcagttttgttcacaaccaaggcctgcgacttccactccaaaatgctgagggaaaccctgcttctcagttacctgaattgtagtctccaggggtgtgaaagccagggtgcttcttttaatttcctgctccccgtgatttcagatcccctcattcagtctttgccatccttgtacattgcactacaatctgccacagtgtggaagccagaactctgagtcattactgctgttccctgcatccttaaggcctcggaaatatatctttactcagtccacttctcacttagtttctcagtcatctgtttaacccaaactatgattttattttccctggtctgattgaaaaatcttcatcctggcctccctctatctccttctccatatgaaaactagaactttttttttttttttttttttttgagacagagtctcgctctgttgcccaggctggagtgcagtggtgcgatctccgcctactgcaagctccgcctcccgggttcatgccattctcttgcctcagcctcctgagtagctgggactacagacgcccaccacaacgcccagctagctttttgtatttttagtagagacggggtttcaccgtgttagccaggatggtctcgatctcctgaccttgtggtccgcccaccttggcctcccaaagtactgggattacaggtgtgagccagcgcacccggcctaaaaaaactagaactcttaaacacatatatcagacaatgtcttttcaaaaactcctaatgatttctaatgaagattaacataatatcagatccctatgcagtggtctacaggctgtcatggagatgcctctaaattaattgcatatcttggagtttgttcacagtataccaggctccaggtcccatgaactgatgtcagtagcttttaagaccaaattattttctgcctcagcacttttgaacattttatgcctcctccttgtaaatctttctgcctctgtttgcaaaggtcattctttatatccatcaggtgtcagttaaaattatactgttggagatctctatgaatactccattctttttgtcattccttttcttagaatcctgtttttcctgcttattcttacaacaatttgtaattttataggtagatagctagcaatcatttacttatttttgtttgacattcctattactttgtgtactctgtgaaggctgaactatgtctacttcattcattcattcattcattcatatatgctcagacccagtgcattttttttttgctatatagtagtgcttaatatattattcttgaatgaatcaatcatttgatcaatcaacaatgattttaggcaaatttacctctccccagcatattttcctctgagcataaatggctcactgaaattctggcctgtaaatagaaatgtatatttcctaagaagactgcgagtataccaatgatttgaaaaatgaacagaggttcttacatgactttaagaagataattccctttcaaaatgatgctttttccaaatctagtaacaggacaaagtaagatcattttgttgcttcactctttaacattttaattgtcaaagagcttggagaattctctttgaggtttagtgcacagcaaagtgtaataagaaaaagtattggtttcaggttacaattggtaaaagaaatattttaagatgtctttcagcaatcttagtgtttctctgtaatcataaatttgaaggtactgattttactatattggtagtaatcttaaagttaatactctagctgcatatctcagaatgatatacaaaacaaggatttccattttatttggaattataaaatgcttttacaaagcctgaatttgtccatagctcatgaatattccttttgtagtgttgttttgctattttagaattcagcaaaagaaacttgaattcagactacattctaagcatcaataagtatagcaatcctataacacaggcaaatataaatgcctgttctaaaaaagcttaaaaagaaaaaaaaaagtccttactgagtatataaaatattacgtttttactcatttaatcatcatccatgaggtgacaactattatctcaattttgccagtggggaaagagtcatacagaaaagtcccttgttcaaagtcacattggtagtaagtgactgtaaggatttgattgcaagtttcttaaacatcaaagttcaggttcttttcattgctgattgccttctgactttttgcatcatccagttctttttctttctctccccctacccttttccccattctccattccctttcccctaccaccttgagacaaccattctaatttacataatgtgtacatctggatttgtgtgtgttcttacatgcattttttatttacttgatgctagtttccacttttttgattaaacattctatttttcagctcacgttgttgtgtgagcatataatctatcacttctcattgctgcatgattctgtccattaatggaaaacctgttttcttctaaccttctaccatcataaattactctgcagctaaaaggcctatgtcacttatttttagtgcattatttttaggttataccgtatatatatatatataatatttatataatatatacttcttgtgcctaaagttctttacttcctccaagtcataaagatattttctcatggttttttcttatatctataggtttacatcttagatttagatttttattccacctttgtatctgctgttagcttagttccagttttattttgatatatagtatgagccagtatttataatacgatctattaaacaattaaatagtttaaatatttttgtattgtattcacaaaaaggaacttatttttaacttctatgtgtgtatatatatgcatatatacatgtatacacatatatacacatacatatatattttttgagatgggagtcttgccctgttacccaggcgggaccataggcatgtgtcaccatgcctggaaaatttttgtatttttagtagagatggggttccgccatgttggccaggctggtctcgaattcctgacctcagatgatccggccgccttggtctcccaaagtgctgggattacaggcatgagccaccgcacctggccaggttgcaccatagtatctaaagatttttctgtgtctttacaaccattttttttgccaatttaattggtgtaaatgatatttattgttgttttaatttatctgattactaattaagcatctctttgtttacctattagcattattagtttggcagtcttaaatatcacaaatatccttcttcattctgtaatctatgactttttttgcttattttttgctgcctttgctttaaaagttcttcacttcctccaagtcataaagatattttctcatggttttttcttatatctataggtttacatcttaagatttagatttttattccacctttgtatctgctgttagcttagttccagttttattttgataatatagtgtgagccagtatttataatatgatctattaaacaatgaaatagtttaaatatttttgtattgtattcacaaaaagaaacttatttttaacttctagagaaagaaaagtgactcttaatattataacgcctttcccataatagagtgtactggtattttttttaaaataagtgcaagtcatattttatgcctgttttgaatctgatcaaaaaaagtttttcctatttgtgtgagtctgtaaaggcacatttccttttgttttttctgctttagcctagagttctcgttggaactgacatgacataggattttacattgaatagttaaagaaaaaataactctttttccccccagcaattaatataccactatcgatataatgtgattttatcagtttaaatggaaaactgaaattaaagagaaattctctattaaagataatttattaaaattggtaaattatatgcatttgaataaaaaaaatcattaacagacttttatttcttttccaaatatgaagatgaaagtgtagatttcagatacatataaaatgcatgttttattatagcattatatgattttaatagaattattttccactaaatgatggttgcttaagaattttggaagaatggaatttttgaagtatgagctagaactgaagggaagatgaagagtccgaaatggttcctaattccattaggggaaaaagacttttcaatcagtcactcgagtgtccacagagaaacgtctgatgctatttcaggggataatctagtggaggaagatggcctcaattgaaatgcttagttgattatgtagttcattccagaataaataggctatttactttgtctgaaagttcaatagatttggatttcagtcaaatggaatggcattagatctttctttatgaatgttgatacaagtgtgtttagagaggacttctgtcagtttttattagtaatattcttattggttgagttttcttctccctcatttgctcagtgctccaattttgtggaggtcattttatttttgacgttatgacataggcaagtagaagcctctaagattttttttaaaaaaccctgttacaatgttttattcttataattttgtaactttcttaatcaaatgctgtggagacaaactgcaagaggaaaggttctttttaagggtacacacatgttggagatgaaattccttgagtttttgggagaaaataagaaacctgctgattctctgagctagaataatttatacttttctatgaacattagagaagtgatatactttaaggtgtgaggacaaaaacttgcaaaaaaacaacattgcatttgaattatagatggcatctaaatgataaaatgtataaaaatatccctaaaagataatttctttgtcataattgagaggggagcagtagcgtataggagagtttgccacacagaagatcaaatttcagctctgacatttcctactttgagaatctagctgaattacaattctaaacttttgtccttatcagtaaaatgtctatatctgacagtatacaaggggtatcttttgtgcctagcttaactgggccctcagctgtttatttttttaatttttccttctgtcctccatcaccattcccagattcttacattaaggacaactaagctaaacattactcataaggaagacaccttgtttgttttattaatagctagtttagcacataatacattttaaattgtctgcctatgactaatggcaaaaggtgtaagtccgtatttctttagagaagtaaaataattggcctttatttacagtgatcttgtaatctttgttcttttgtggtggttactaattatgtcagtgtcaaactaatcatattaagtaatggaggttaaattcccccagtgatttagaatacaagaatggaatattttggcattaaagaatgacttttcttttggaagtacatcgcgaagtctttgcaatatacatatttgtcaattaccatctgtgtaaagcaacagacagctgctcagtagcatttcctggagtggactggaaggatctttctcaccatatgactctgagacagttagagacccaccaaattgaagattacttgatgtaaattcacagcacatacctggttgatacagtttatattaacatgtttcttctaagaaacaataagctcttttttttcaataaggaaaatatttttatctgggaaaaactgtacaacatttatatagtgaatgatattcttttaaaataatttgttataagcctttcctaacagtgggatatgacaaactagaacatgtgcaatacaagtgatattttaagaagacactcagaaatgtaatccaacttcaatcgtggatgccccccagttttgtttgttttctatgtctggaattttcttgtcataaaattctaaattatttaaggtgaatatcctttgcaaaagatggtgtctaaattatgtctccagaaaagttagaaacctgcagtttcaggaatattttcattgagtacccatcaagtgccagaaaatatattagggacaaagaacatttctgtaaatagaacaggcaatgatatttgcccatctgttgggcttgtattttctctttgagtaaccactatgtgctaagtgaaatgtagtcaatttaaaatggtttataaaataataagaaaaaagtcatttataggtacaacattctttctaaggagtgcagaagctgaagttattgttttgctgagacctggagaggtttgcatattcaaaattgggggaagagctaattacttgtattgtagaagaagactttggaattcttgtggaggagattaggtggagagagagggtgggggtgtgagagagagtaagaaagaaaaagtgaagtacatgtgtttcccaaatgttgtgtttctgtacatctcaggcagggaacccattctccacccatctgaccacttctgccttatttacaaattttgatttgctggaaagggaattctactggcaaatgcacagtctgtttctcactgatacaccttggctgagtttctacctacagtctgacccttttgaacagaaagtgttaaggacttcccgttagggctcgtgcttaagcctcaggttgaacctacttgatccttaagaaaagcaaacaaagcaaaactctcaaacagaaagcactgtgtacttatttccttccataaaattttattgtgcactgtgttgcagggactttgctgagcttcacaaatttccttcatacaacttttactgcatgtaaaagagacccactccaaagttaaagtgatatgttgtcagaacatgaaatcaaaccagaagtaaaaatactggatatgtaaaaaatataacagccttctagtaaatatgcaaaaatcaaaatatgcaaaaaatcagtcttctagtaaatgcaaacatattggaaacatgatcattactgataactagaaatatttctaatagcagaaaataaacagaaaatggagaagacataatcaaagaaataataaaagaaaatatgacttaaatttacaatacaagtgccccaccacaatttaaaattttaaaaagacaagctgaaggcacatatttatgaaaattcataatactagagttaaagaaaaaaatttaaggtctttagaaataaaaattaagtcaaatcccggtgattagtactcaaaatgactttacactttccaacagtgatcctagaaattagaagaaattgcagcaatgtattcatattctgaaggaaaataactatctttcggtctgaattgtcatgattatataaaggttaagtaaataagttactccaactttcccaagttaattttttaaagaaacatagatcttgacttccagctaatacacaaagtttttaacctggaggaaactgctaactgagctgtgatggtaagtaaaatgtgtatttcttttcttttgggtacaatagctatatcattatacagcaaaggagagaaattgctacgcaggatttagtgatattttcaaggatagcatttaataggagaaatttctgcttgaggtgaagatctgtctggaaatttttgttagactaatttttttaaatgttaattatgatgctatactttttctgaatcagttcaaggagattaatagtcaaaaaagaaggtgtgcagacagttgcttaatgagatctgagaaggaaatttagaatcctatgttcttttcatcatcaacaggcattttacctaaaagtctagaaagacaccattgtgattttttttcctttgtcctgtaactctttcctatggcttggacagtgacaatagcattcgtgctgttcaactggcagggaacctaattatggctgttttatctgaagctcagataatttcagagctctttgaaaagattattaccttaatctaccagttaaattcttcagtgcacttatgagaaccatagcatcaactctgtagattgtaagagaaatctagaatttagaaagatgagggagtgagcaaaatgagcattgaattagatgtctggagacctaggttctggaactatttttgggtagttgacctcatctttttggagtgccattgcctaatcagaaaaataaggacgatggaataggtggtcttctgaatctaaattattttgttgaatttttttctctactttgaattctcaaaaatattttgctttagaagcgttctattagtatgtataatgatgtaaagcagcggtccacaaccattttggcaccagggatcatttttgtgggtaacaattttttcacaggccagggggtactgagagcgggggatggtttcgggataactcaagtgcattacaattattgattgactgattgattggagacagagtcttgctctgtcacccaggctggtgtgcagtggcttgatctcggctcactgcaactgccgcctcctgggttcaagcaattctcctgcttcagccacctgagtagctgggactacagatgcccaccaccatgcccggctaattttttgtatttttgtagagacggggtttcaccttgttgcccaggctggtctcaaactcctgagctcaatctgccctcctcagcctcccaaagtgccaggattacaggtgtgagccaccgcacccagccagtgcattacatttattgtgcactttatttatattatcattacattgtaacatacaatgaaataattatacaactcaacataatgtagaatcagtgggagccctgagcttgtgttcctgcaactagagggttccatctgtgggggatgggaggcagtgacagattatgaggcattagattcccatagggagagcataacctagatccctcgcatgtgtagttcacaatagggttctcactcctgtgagaatctcatgctgtggctcatctgacaggagacggagctcaggtggtaatgcaagcaatgggcagtggctgtaaatacagatgaagctttgctcactcaccagcagctcacctcctgctgtgcagcctgattcctaacaggccaaagaccaatacaggtccatggcccaagggttagggacccctgatgtaaaagacttatatatgttggtgaaaagagcagacacagaggaaattccacacacacatggatttaaatcttggatttattcttaggggcagtatcatctggaatggattattctgcctctctgagattcaccttctacaactataaaaagagaaacatggcacttagttttcaatatttttcaaaaattgctaatagtataagtacctgacataataaaaacattcaattaatagcaactgttatttgtgtgatgttttctaacttaagaactaggacatgaatttaaccacacaggaattctcatttttgagaagataaagaatgaggaaaatctgaaaaatattggaaatcattaataaaattctcctttgatcaaagatttatttcggcattccctaatttgccctgctcttgggtacgttagaatacatttatcctactttacactttgaaaaatttgtgcaaatgccatgattgtagcattagcctgattttttcccagtcttctggtttttttttttttttttttttttaactcaacatatattgtgaaacactcgggtatttattcctcaggaaagtatgacatatgaatgagagctagaggataagatcttgtgataataaatttttgaggttagtctctctgtgtccttgcagttttcgcatgtaactacttactctgtggagtctacacttatatgtaaaaggcagtttctgtgttagctggtttattttaaaaagaaaagacttggggcagtgaccatctcccttatctgaagacagtgatattagatcattcccagactggcctattttgctttcacatactgcaaaatgcttgatatgcctcatttttgtgctttagtaatcattcagactttgacatgcatttcttgagggtgttataacatgtttttgaattttctccaggaagcactctgatgatgtgatgaataatttagctggataactatttactagagaaaacacgaaggatgaaaaaatctaaacaaacttttttcactgagataaataatgagggcacctactcttttggcaaacggtataattactgctttcctggttaccagtgaaatctgggatatgctaatgctttggcataaacaactgaatataaatctcaataattgaagtttgaccaaaagaggggttaaatatgtctaagaggtcaaacacagagcagaaaaaaaagaatgggaaatgatcttagtctgaatcgcaagattgcatgttttgcttttactcaaaagagaaggaactggtatttagaaggagtttttttttcagagagtaaggcgttcagagtcactgggtctgagtgtgaatgctggcccacctgctatgtgaatggccttgagcaaggaaatacatctctcagcctggttttccacttctctaatataggatcacaccctctgccttggctacataagagaactgttataaggtatgctaaagttgcaactgagaaaacctgccgtaagctataaaggactaggaaatgtcagaaatgattgtaatgctgttggcccttcagctgcagtgccagctgcagaaattaaaaggaggctgaaaatttgatgttgcccttggaagtgaggggaaacattgttctcctcagcaaacctggtctaacatgtctgccaatccagtgaacgtatttcagcatgtgtcatgtgggatgcaccttatgaagggctgtctatacagatgttagggtatatcttagttaatttggcttataacaaagtgccatagagtgggtagctcataacaaataaatttatttttcacagttctggaagctgggaaatttgagaccaaggacccagcatgttcaggttcctgtgtgggctctcttctgggctgcagacggccaccttctcgcatgtcccctcttagaaagagaataagagagctcttgggggttccttttataaaggctctaattctgtttatatgaactattactgatgacgtaattacctcccagaagccccaccttcttatgccatccttttgggggttggaatttcaacatatgggtttggagagacacaaaccttcagtccattacagggtccaagttgcttcatgatccacaaactaccaaaatctaatacttgatacaaattcacccagaaaaacattagaatacagggatctgtcttgttctaaaatgggaatttattatgcttaaaccaaaccttatagtgaatccttgaaaattcagaccagagtctgaatgtacccctctagggtacttaccacttggatatttctagtaatttataatgagcattgagactgcccattcagatatattcatatacttctttaaataatcaaaacgtgttttctcttcccttctatttactgctgattttcattctacctaacttctctgcaaagatggtttaccttggtaactagcaataacaataataataatagtaatagtagtaatagcaaaggtatcatttacttaactccatcagaattttacatactcttatttctgattttattatttctttaccatgcaaatttgaacagaatcatctctgtccaatggcccatctttcttattactcatccactcttaactgcttgcaatgtataaccgtaaccctgctctaaaactactgacctaacaggcagcagggaattccttttattcagttcactagctctttcaaaattctaatctgctttgacttttcagtaccatttaactctctggaataatttctttgtttttgaaatcctctatactgtggcatgtcaatttatacctttgtgagagcttcttggtctcctctgtctactccctctgttcccagtccctgtgtgtaaattctgccctctccattcccactgtgactcctcagttttaggctgtcatcatttctcaccaagatgttgaactggctcctccgtgagagagcagagtggagaggtgaagcaagtgtctgcctgccttcctggtccatgacctctccctgcccttccatgctgggtgaccatctgcatgtaaagttggttttagctttcttattggtgaagtggggataataatagtatctattttttggatgaatgggaggggtcaatatgttactacgtgcaaaaatgcttaaaataattcctggcccttggtaagtgcaacataagtgctgccattactgtctttgttttaatattagttatgatcattatcattttaagtggtctccctgctgttggatcacttgcttccagtacattctgtacacagcagtcaaattattgtaaaacaaagcttagtttatgttactaagctgtttcatattcatatttgcattctatattgcctaacaattttaatcaggccctcaatagtcctggtttgtgtttcctggcttgtctgcaagtctcagtataatagtcagtactgatgtctcccttccccaccgtgctttccttactttctagaattgtgctttccttccacctccattaaaatcctacctgccattcacaagacccagaacaaatgctaccagacccttgatgccttttgtaatcctctatgatcaagcataagtctgtcctctctgaaactattaagtaaaggtctttattttaggtttctttttggccccatatctctgtatttggtattttatttatttatgtacatgttgttatcttttttcctagattataaactccttggggaagagcctttatatggccttccagctccctgcacaggacattacatccagtagacagatgttcaatgaagggctattgaattcatgtggatttccatgtgagaatagagctggatattcacttccctttttgctgtgcttgctaagcagactcatttgcaccggccactaccccagttggtcaccaggaatagagggtacttatggagattcttttcccaccccccaccatcttttaggatttagatgttgtttatacactgaaaagttcagcttttggctcatagtagcagatactgttggatatttgttgaatgaaaaagaaaataaatagtaaacatttgctgagtgagaaagaaaaaataaataatgaataaccacaccctgacccacttgtctgccagaagtgggaaaaagttgtaaataagcattttctggaggaaaaacacacaacccacacttgcttctgaatggtgtgggaaacatagattgagtctaaaattgagaggcatgcttatgtttactaagcacatggagaagcattatcagaacactactggcttttgcaatacattctttcgtcttttcaaaagtaactttttctatcacatttggcttaggttaagattcaaatcaatttacccttcacttgattcgtttttgtcagtgtggtaaccttatcagcaatgcagtttgcacccaaaaagatttgctgcagaaatgaatgaggccctctaagcccaatgtgaatataaactccacagcgatggtagaaatggtctcaggtgacccgtcagaataagaagtacttcctctccagaggtcctggcttgttatcccccagagccacacagtgaatgaagctaaactcctgttcttgaggtggaattatctcataacatttgacactttagtagtttataaagataacccaggaaataaaatttcaggagttgaaacaagtattcactgaagacaggacaactaaaatatgccacaaaaattgaggatcaatatatcaatatggaaggtttttaaaaatttttatttgtttaacttttatttttgtgcttggcttttcttgggatgtatttaggtatgaagacagtagaaataagatgtatacactttgggaggctgaggcaggtggatcgcctgaggtcaggagttggagaccagcctggccaacatagtgaaaccccatctctactaaaaatacaaaaaattatctgggcatggtggcaggcacctgtaattccagctacttgggaggctgaggcaggagaatcacttgaacacctgggaggcggagattgcaattagccaagatggagccattgcactccagcttgggcaacaagagcgaaactccgtctcaaaaaacagaatgacttctgctgagatatcaagaccacgttggtcttgacccctgcttccaggaagccttgcttgactgtctagggctgaattttataccattttaaaagaccctgctaattcctgtccttacatacatcacatagcagtgatcatttaattgtccagactccccatctacgtcacaagccacctgaaggcagatcacaactacatagctccttgcctggtgcctggctctagtctatatttaccggatgctgtattaaaagaggtaaaaccaaggcatgagtctgctgttgcagctcagaggcctcaatcagacagatgccaagctgcatttgatcggcagtcttgtatatttgactgacaacgttctggcttgcaagtatttaataacaacagaaagtgaattagtcaccaatacataaaaattgagagactttacacaaatctgaattcctgggctctcttgaaatacctgaaaatctgacgacgttggacgtacattgctacaaaaacctggagaagaatgtcatggctatgaatagtgaaagtattctccactctatcctattccccctggcacttaaagcttccttagttctcacctctaacaacccactgggcctataggaacttggagctgttccttctcttcctgggtgtctcattagagggatgaccccaagcttctcctccccctcttccctctgactcttcctcttgttaaaagagcatggatcttgcttcctaagaaggatcttatcctctaaagccattgtcctgctgagcgacaggaagctcctcatctacagtggccctgcaggtaccgagaaggcttttcatgcagctctgactccacatgggagtgatcacaatcaggattccctcacagactgcctggcttcagtgctgcactctcctgccttgagtcttgaactgcttcgtgatcctgaccacagtcttgtcacctgcttggcctgagaagcatgaaggtggtagatcctggtgccgctcctgaccacccagcagataacactttgattttttttctaagtagaaattgatcagtgtgggatttcgagattttcaaaggtgcctttgtttaaatcgagaattgggcaaggtagggatcttcgttaaaaagcaccatgtggtcaccggggttaatgaggcagatcagagcagcactgacactaaataaaggccaattaactccaatcactgcaggcctgggtgctttctggcagtgcaatctccctgtggggggcttcttgtcctgacaactctctggcagaggtaaggaggactggctccaaaagaaggcccctgagcaatggtgtggggtgagggcattgcccctccccaccacactgcccatcaggggcttatggcttttcttggaaggcatcgcccccacccagcctgccctgcatggtgctgtggacagagaagcaagactcagagactgaggccttctgtgggctcccaaccagctcaggggccaagcacagagattcagattctcaagaccccttttctctatccatttaattaattgccttgaagagaggatcacagagttcttgctgaaaaattatttaagtccatgaatgaagacaaatgatttcaacacaaacattgctcaattgggtacaaaaaatttttttcccttgtgtttgctttagtgataaaaatagccagtgctgatgatataaatttcacctcgtgccaagtgctgatctgaaacctttacctacattggctcagctggtcttcacaaattttctatgatatggatactattattaatcccatttatacatgggaaaacagaggcattggaaaagttcagttctatgctaggtactttccatgcctacttctatgtgattctcataaaaacctctgtgtggtgagtatttttagcactatattacaaatgaggacactgagattcagaaaacttgtgtgacatatctggtacagtattgctcctaatgatactaataaaatgaggatttggattcactttttttttctatttccaaagtatggtggtatagaatagctaactgcctaggctgaaggatttaaaatttttccttaagatttatctgtgagccctcagtttttctattcaaggtttctggattggagagtataatcagtaccaaaaactaataatgatcttaaaatagtgggtacagaataatgcctctggctccagcttgctccattgagtttcacacctggctgtattactttcttgcttctgacttctttcagccactaagccgtggatgttctcagtcctcagtcattaaagactagaacatcgcccaaagccaccttcgctactgcaactacagtcattagcataacagacctcagcatccacagaatcacttcatccaacaccccgatctctcattccctttgcctcctcatctccaaccaccttcttcgcttcgtctaagccacacatttcatcatcataccttggaatttcccaataccaacaactatatcagctctaatattccatgttaaaatgctccatttgtttatcaaacaccctctgttactatctggttagttcaaatacctcccatattctctgacctcacgaaactcccaatttcccccaacacttagctccctgggagcaccacttttctttcactcctgcttggatgccatgattccagcattagttgctctcttcctacttcaaacccacaagatgaaccttcctatcaaccttctccacattgacaaccaagaagttgtagacaatcacacaatgggggagcttggctgtattgtttatgacatacattcaggtcatctctaactgagctgtcagtcctgctcaacagtctcactaatttttctttcgagctcactctcccaccttttatgctaccttataaatagctcttctccaatccttccgtttcttttcattctcacttcaaacacaccagactcagccaccatcaccttactcaaaagcacaaatatttttctaatcagtcttcaattcagtcttgccactttgcctattcattcaccacacataagtcaaaataatgtgtttagatcctacattttatcatttgattcccctgctttaaaactttagtgtcattccatagctaataagataaaataaaaattcttacctcggttatcctacaagtattggttcatctggctgtgcctaaacctcaccattcttgcatacaataatccacccctttacattctaccttcatgatcttattttagtttcttgaacatgccaagcttctttccaattcaatgtattttgcatttgttacttatatacttgtctgtctctgaaaaacagctcccgttcattacccagctttcactatttcaagatctcaacttaaatatcacattcacagtttttcacgaagccccctctacccctgtctgttgtgagtcactgctcctgtcattcactcttccagtgctgggtgcttttcctttaaaggaccaaccatttttagaatatttacatatgtacttatatttttaaattctatcttggaaatcagattgtaagattaagaatggaaggttccagatatgctcacttactattataagccaggatctagtacagtgaaacttgagaaacatcttataaacatttaattcactttaacgtaaactagatttgataccttggacttggtgttaacctcccagaacctaatttcctgagtggcacaacaggggcacaatactcctgagaactatgatcaggttgcagtgtaataatgggtggaatccacactttggcaattctacagtgctttgccaactacaaagctgatgacctcagtgacagtgagcacacccagtgcccagagcttggtttgtaataccattcatcaattaaaacaacttggtttccttggagagatggatgattctagggttaaagcaagaaatatatatttacctatatgaacctggagcatcttatactgccagaaagcaaggaagtgctaaaaacaaaacaaatacacacacacacacacacacaaaacaaaaacaaaaaactcacactgattgttagatatcaaagggacacaggagccaacaaaagtatttcaaatggccaaagctgaaaaaatttgagcaacaaaataaataaagtagttttgtattataactgaaagtataagacaaatgttgatgagaccatgcagatataaataaataattgaataaatacaaaaatgagaaaaagagaccaatatgccatgcagaagaatttacgataatttatgtagatattcagtccttgaggtgttggctgtacatagtgaccttgtttctccttcctgaagagtacacagggaaagaaggaacaaggaataactaaatggtaggaaaatctgacaaacactaccccagcccggtaatcaaggtcaatactcacaatcataagtgatgctgatattatgtacctttgataggacatgatgaaaatggcactttacatctgtagtcttccttcctggaacccataaacccaatctaattgtgagaaaaacaccagacaaattcgaatcatgggccatcctataaaatacctgaaccagaactctttaaaaccatcaaggtcatcacagacaagcaaaatctgagaaattgacacagccaaggggaggctaaggaaacatgacaatggaataaaatgtggtctgctggaggggatcctggaacagaaaaggacatggggtaaaaatgaaggaagtctgaatagactgtggactttagttgataacttcctatcaatattctttcattcacagtgggaaatacaccatattaacgtaggaggtaatgcaattttatcttactttatggtggaaataatagaggaaactgggtgtggagtatgaggaaaacttctgtactgttttctcaatttttctgtaaatcttttttttttaaaaaacaaaaaacaaacaaacaaacaaaaaacacagagtcttgctctgtcgtccaggctggagtgcagtgtcatgatctcagctcactgcaacctctgcctcctgggttcaagcaattctcctgcctcagcctcccaagtagctgggattacaggcatgcatcaaccacacctggctaatttttgtatttttagtagagatggggttttaccatgtcatccagggtggtctcaaactcctgacctcaggtgatctgcctgcctcagcctcccaaactgctgggatcacatgcgtgagccaccacacctggtcaatttttcaataaatctgaaacttttcctttttttcttgagatggagtctcgctctgtcacccaggctggagttcagtggtgcaatctcgtctcactgcaacctccatctcctgggttcaagtgattcttctgcctcagcctcccaagtagctgggactataggcacacgccactgtgcctggctaatttttgtatttctagtagagatggggtttcaccatattggccaggctggtctcgaactcctgacctcgtgatccacctgcctcggcctcctaaagtgctgggattacaggcgtgagccactgtgcctggcttaaatctgaaacttttctaaacatgaaatctactttaaaaatactgtgcatcatcatcatcatccacttgctgtggtctaaaaatactcagatgtatctaccttctttcccccaaatcgatgcctttgttgttgctttcaatgtacgttattttgaatgctttgtatactgtagagtgctccacaaagtcaggaagctctttttcttgtatggctcactgccctcttcaggtgtcacgctggatgttctcaagttatctctggtcttgtcaggctttactcctccttcctgtcctgaggcacaggcttgcactccctctttctctacctctgtgtttgctcacactcttgctctctatcctgctgctctaccttctctttctgttcttgtgggataactatgggaataaaattcagatttattttcctaattctcttctgaaaattttgaactggggaatattgatgtcttctatttctatcttctaactttacaaaataaggatattctccagattcacaaggaatgtgtatgagcactaagagaatgcatttggaaccctttaggcaatggaagaggaaggaccagaaattcagcaaaatcaatagctgagttcttacagagaaagagaggcagggaacattatgtctctatctatgatgagaggcatgtttttctactctctaggaaatgacttcctgcaaatgatggccagataaatcagaggtcatggtccgtggaattgctatttttctcagttgacaatgtgtagacgacagggtttataaccagtactacttctcatgccatttgctctgattttataacagcgacttcagctccaattgtggacctgattgcaagatagtcttaaattctcaaaaggagctagaaccctggaatgtatgtaaattttttaaatttatttttaaaacctgaatgccaaaaagtatttgaatgaaagagtcaatcagtccaaaaacaattgcgtacctctctggaaggtctagtgaaagggaaagagaagagagaaggaagaaaggagaatggggaaaaaaaacttttcttccttttacatatccagctgtaatgagttcagaatgcaatattgtgccagtgggttacagtgtgtttcataaaaggccttcaattcatgttagttgagtgaataaataaagagatacattgaaaacaattttaaggtcttttgtaggagtgattagcaaacatttataaatacaaaaaaaaaagttattaagaattctaggccgagcgtggtggctcatgcctgtaatcccagcactttgggaggctgaggcaggtgaatcacctgaggtcaggagttccagaccagcctggccaacatggtgaaaccccatctgtagagatatacgaaaattagccatgtggtggtgggcgcctgtaatcccagctactcaggagcatgaggtggtaggattgcttgaacctgggagacgaaggttgcagtgagccaagatcacaccattgccctttagcctatgtgacagagcaagattttgtctcaaaaaaagaaaaaaaaattctgatttttcctatgatgtctatctaacaaaataaaatcaccatattttcttgcactttgccctgaaaagcatagtattaatatggaatgaattggagttaggtaaatctaagtttaaattctacccctattacctgctaactacagggccttacatgagtggataactctctcctccttggtgtctgcatcttgcataagtctctggctaaactcatcaattaccagatactccccatttatttcccagatagtgcctaacacacatcctttaacagagagcaaggttttgtagtcatctctctttgtaaccgctttgttatttaatagttgtccagatgcagcagtgctgtaggtgctgtacgagaataaaatgcatcagttaaaaattattccaacctagtttattgacattctcaattatattggtcatgaatggaacgttcctagggaatagatggtgataatagttgtgctcaattatggccttatcatttttaggtgtcctctgttttctatgactcataattaggactcaacatttttatatttgatcattttatttttcttattagagtccattattctcctgtgaagttttgccagagatatggcatacaaattggatttgtgtatgctgtatactaagtagacatttgaggaatgaaaaatatgaattcacaaattaggcaggcatccttgttgtatctatcatatggattttcatgacacagactaaataacaatcattgcacaaaggccgtagtgcagcagggcaaatggtggagttacttgtttgatattaattcagtgctttgcccaataatgcaaaattgtcctaatgttacatttgaggaaaaagacacatcgagtgccagcattcaaacaggcagtgtgttaaggatatgtttataggttgccttatcaaacagttacaacaaaccaagagaggagttgtctgtccttcaaagtttagatgaggaatgtgaaggttggaggtgtgaaatgccagtcttatggccacatagctcccttgtgatagatccaggatttaatgctgggtatatttcacatcaaccataacataggtcttccactttgagaaagatacgtatttaattttacttggaactcgggaaattagaaacaaaagcagctgtggattgaaagataggaattgtgcagattgggcctgaaactgatatccccaggaaactaattgtgaaatggaagatgaaagttgggtgctgggtgtgacagtctctgggattattccagagctcagacctattctgtggccttatggaattaatgcaaccccatatgaaagggagcttttcagtcaccatgggttaatttcagacaaataaaacatctgccattgatcgaaaatctgaatgttcaattttacagaagttgttatctttttcacttcagttcactttccatttaaaactgaaaatcaatccttctcagggcctttgtgtgtttttggagatgcacactacaatttcctgccaaaatacttgtcaaatgttagcatacatttgacaagtagtccttgggccagagtcattaagataaaaaatcctggtttactcaatctaggaagacccagcgcacctgacaccaagtctgtgcagagtaaccttgaattcaggatgtttatgaaaattccagcacctacactcctctttattaattataaattagatggcacaccgtagtaatcatcttgttaaacacagccataggcaaacttagaaaaagaaatattaagtaaaaagtagtataataaaatggcagcagaacaactaggatggagtttgcaaacactgaccactccgtaacaatgaattaggctgggtgtggtggctcatgcctgtaatcccagagctttgaaaggcagaggtggaaggattgcatcagccccggagtttgagaccagcctgagctacatagtgagaccttatgtctacaagaattgtttaaaaatattatccaggcatggtgctgcacacctatagtcccaactactcaggaggctgagcggggaggatcacttgaggacaggagtttgaagttaccatgagatataattacacctttgcactccaacctgggtgacagggcaagaccttgtctctattaaaaaaacaaaacaaaactgataaacaaataaataaatagataaaaataaataaatgttattcaggctgcagccaagtatttcctgttgctacaatgccatactttctattccctgtcccacaaaatacgcattcatttctaaggctgaaaagttgcctagacagggttggttcataaatggattgctctttcagtcataacaaaaagcgatacatcttcatagtcaggctaaagggcttagtaattcaccttatctgtgtatctcctaaagaaattagcaaaatcactgagtttggcgtttgtacttggtgccctggctttggtggaacctataatagtggtacaaataacacatgggagacgtttataatgccaaagcagctagagttgtaagtgcagcattataggagtagagtcatgtctttcttggagcatcaggaagggattcttagaagtgacatgtgccctggattaagtagaggcctgaggcatcatattccttcaactttccaggaaatctcaattatatctggaattagatgctgggaaataacatgacaatgacaggttgggtaaagacaatgaatgggtcaccaagaggtttgccatttatcttttaagccatggcatttgcagtgggaatatgtcaggatcagatttctggtttgagatcgctagagaagcagagtgagaatggactggagtggtagtgactggtgacagagagaccattttagtcttctccatttcactgagtaaaattagggagatagtaaatctattaaaaaggtagtctaagctgagctggggaaacatgacccccccatacaggcaggacacaataaatgactaataaaacagtatacatttaggtgctacatgatgttgtacagccttcatgtggtaaaggagttctgtgaagcaagtgagcagagaggtctggagttgataggcttggaaatttgtttcctcaaaatctcatgttgaaatgtaatcaccaatgctgtgagtggggcctggtgggaggtatttggatcatggggcaggttgctcatgaatggcttaataccatccccttggtgatgagtgagttctctctcttgcagttcacatgagatctagttgtttaaaagagctagagactgatatggtttggctgtgtccccacccaaaatctcaccttgaaatgcaaaccccataatcctcataatccccacatgtcaagggagaaaccagctggaggtaattgaatcatgggggtggtttcctccatgctgttctcctgaattagttctcatgagatctgatggttttataaggggcgccacccgcttcactcattcactctcctgtctcctgccaccatatgaagaaggtcagtgcctgcttccccttctgccatgattgtaagtttcctgaggcctccccagccatgtggaactgagagtcaattaaacctctttcctttataaattacccagtgttgggtatttctttatagcagtgtgaaaatggactaattgccgagaccagctgggtcgtggagaccttaacccagcggcgctagaggaattaaagacacacacacagaaatatagagtgtggagtgggatcaggggactgacagccttcagagctgagagccccaaagagagatttacccacatatttattgacagcaagccagtgataagcattgattctatagattatagattaactaaaagtattccttatgggaaacagggatgggctgaaacaaagggatgggctctggctagttatctgcagcgggaacatgtccttaaggcacagatcactcatgctatttttttgtggtttaggaacgcctttaagcagttttccgccctgggtgggccaggtgttccttgccctcattccagtaaatccacaaccttcagcgtgggcatcatggccatcacgaacatgtcacggtgctgctgagattttgtttatgaccagttttggggccagattgggggcctgtgcctgacactaaacagagacctcccccttctttctcttactcctgctctcaccatgtgatgcacctgctccccctttgccttccaccataattggaagcttcctgaggccttcaccaggagcaaatgctggagccatgattggaaagcctgcagaaccatgagcgaactaaacctcttttatttattacttacccagccttaggtatttcttcatagctatgcaagaatggactaatacagtagtcatcaaagtaaaggtgagatttgagttgactattgaaaggggaggaaggaataacataaattgtgtcacagacaaggattggttggtaggacacggagtagtgacaatcctgacatgcccatgttttatgcttcgatttgggaccttaaagtattcagccctactctagcaaaaatggccgcatacaggaaaaagagatcattctgtttgacattttgtatctagagagatttagctctgttgcttgttttactgacttgtaagtacactcattttgttctcacagtattttcttagcttttacattctggctactcctatttccacctgaacaaatgagaaatttagttgctaccaatgtctagccttagtactgctctgttctcagggttcagtgtttccttcaaacaatgtgttaggtaataatcaggtctgatacatgcagcatctgtgaactccttacttgatgctgtttgtttttaataaatatggtgtcacaggtcataggtggggatattttaataagtgacactaggatggagtacttactgactgctaggcgcagtgtgccttctatatgtgatctgctttttcccttttacgaacacgatgaggagggtgtttgaattgccatttttgtatatgtaaatagaggctcagagagttaaaaagcttgtccaaagtattcacctaggactgtgctgattaagaatcttagcactaacctaatttttatctggaatgctggatacaattgaaagtttatagttgaggataggaaggaccaaagattggagtcttatcccagatcattaacaccagttaggtcatgcatccttccttacctgctttgtataaaaaataaaataaaatttaaaagtgacactagaacaacgtttgtcttgttaatgtctgtaagatggtttccaaaacgatgagtctggggacttaataaagcaatttagaagcttttgcagtagcagtaacaggaggtgggtgtacatcagtgggaaagaaagatgtggatggctgagggaagaaaataaagaaaaacggatacaagatagagatgattgaattaggcttgaattactcaagggatgggcaagagaaggtagacaaggctgagatttttgcctctaaatccacaaagttcatgcactctgaatgagatttggagcattttaaaaccttttaagttttctattgaacatttttatcctccaaatcattttcttccagtgtgctaagattatagcctttagctaatggttttctctctcagttatgctcctaccatttataagcattaattttgctgaactgatatagtaaaaatgttcaaaataacatttggcagagcattttactctgactactcaagaataacctataatcttttctttttatactacatacacacacaccacacacacacactcatatacacacttacacctgtttttccaggatttacgtctttacctaaaattgtataaatttttccatagtcgagatgtataatttaaccttccctttcccaagggatgacatgtagccatttatttcaataagaaactccaagagcactagtattcacaagccaaatacagataacaccaaaatttttgctaaataaaggtgatgcatccattagcaaatgttgttgcttttaaagtgatggtttatatttaaaatccagtttaagttaaagttaggatatactgatggtttgcacatgatgagtggcagaataaatgagtcaaagttaactcagaggggctttgtttatttttttgttgttgttattttgcttttcctgggcatgtgggtaaatcatctccccagatgtgatgactgatgcttactgggcaacgaagagaaaatgtcacataggcattggatatgtgagtctggaactcaggggagaaataggggctggagttaaaaaacgtagagcctttgtattagttcgttctcacattgctaataaagacatacctgagactgggtaatttataaagtaaagaggtttaatggactcacagttccacattgctggggggcctcaggaaatttacaatcatggccgaaggcacccttcacagggtggcaggagaaagaatgagtgctgagcaagggggaaaccccttataaaaccattaggtctcagaactcactagtgatcatgagaacagcccgggggaaactgcgacccccactcccgccccgcccgattcaattatctccacccggtcctgcccttgacacatggggattattacaattgaaggtgagatttgggtggggacacagagccaaaccatataatccttgttgtggaaatgttatttaaacccacagactggataagctcaccaaaggcgtatgtgtacatggagtaaagggaagaatgactgaactttgaggcacatcatctttaaaagtcgggaaaaggaagatttaacaatgttgccaatgaaggagcagggaaagaagccacaggcagggagagaaatcagaaaatgaggacatcctaatggccaaggcgggaaaatatttcaagaatggagggatcaatcatgacaagtgccactgagaggtcaggtaaaatgagaactgagaattgcctgttggacacttaaggagaatgactttgagctttgtgaaataaaagcctgcctggaatgggtacaaaagagagaagggagggaagtgagccagtgagtacaaacaagtcttgcctttcacttgatcaggaggcaagatagcatattctgctacagatgaagtgaagtgggttgacttggtggtagaaggctaaggaagttctctcagcaagttaactaggtgagaatgaggggtgtgtgtgtatgtagtgccagagatgtggggagagaataaaaggtgtgagaaagtcacccttgataataagatagtaaattaaccaccaaaattggggccgccagtgccaagaactcacttgagggctctaattataaatttatagtaagaccagtcagcagagtcattcgtttttatctgcatcatgatacatgtaaggaggtgacagagatctgctgaaacccaacttgggattttgacaatggaaggacagaagtgtggggatgttcaactggatttatgtaaggtattataatgatgggaaatgaaatctaaatcagctaagaaagaaaatgagagcacgaggaaggttatggacgatggcactgtaatgtattatagtcaatggattggagatcccaagaggtcaagaaacaactaaagtgacagtgaatatactagggtaagaaagcttgaaagttacaaggtagtaaagtgtctgaaattgttatttttggatgtggcgtaataatagataacgatgagttctgaagtatgattaattaaggtaaaatataggacatgaacattggagaatggctggttaacaaactgagaaaccattttcatggttggaccatctacatgcttactgacatcaccaacaattatggcagtagccttatgttaaaatcaatgccagatgccaatatcatcagaggatggtggtggggaggctatcagaagactgtaaatgatggaaaccagaagcattcattgatagtgaagttttgcattttagggtatgaagaagaaaagaaggaaaatgtcttggaagtaacaattcggagcatgaattgtccctatacaaactccaagacttgtggcatgtggagaattaaaggaatagagaacaaaattcatcctttaatagggcttcagagaaaagttcttaggcgccaattgattttctcttcaagaagggaaggacatattcagagatgagattttcatgatggcatgccttgagtgccagagggtttggggagtatagaagatgtaggagcttgagtcccactaagggatcttcaaaatagtgtatgcttatgggaccaatgaatacagttcatctggaacacttgtgttccctgccgggattgataaaatacagggtctaatgggattgagcctattggtctcagttatggtggttcaaggggcagtcggggagggtgtgttctattataatcccattggagtaatggtcttagtccattttgaaaggtaaagcggagttggagaatgcgggtggttagtgatcacctggacatgtggagctcgtaagtaatatgggggctacagcgtgcagagtccagtgggcctacatttgaccttcctgtgagcagtactgaaggctggggaagacaagcctcaataacttgtcagactgagtcaggactgagattctcaacagtaatcagctaagaggtattgctctcctatcctaagagatgccttctttggcaagactgttcaactatgtctcattactaaaggtagacagaatcacttgggagaatccaggatgtggtactgttttgacacggtccaagctggatgatgtaagcaggagagaatgttctaccaaaaaccttgcaacatcagatcttcagctgtgcagccagtcagcacacagaagctaagctaaagagatgtggcatccccacagggaaagagaaagaagcattaggtaagcaactgcctcatttcccagcagtcatgaaggcagttttgctaagccatctcatagcaggttatggatcctgaatttctatgtattcccttagcccagaatcctgctttgcttttatgaacttaccacaaatgatgctcctgttctagagtctaggggagtgattccaaagtctggctgcagagtagaatcacctggaatgtccaaaataaaaatccagattctacccctgaacaattaagtcagaatctgtggggtcctggcttcagtgtttttcaaaagtttcctagatgattcttatatagagccgtggttaagagctatattctagggctcagattctgtccaactcctttggtttgacaagcaggttggctgctgctagaggactaacacttagctcctttctaggactttgcattttttttcaatgattcatagtcctcagactgactatcacatgcatacacgcatacacaaaactgtcctgctgtggtacaaaatgtgtgccttattgagtctcaatccagggacaattgcagcaagtgaagtttccagaggcctgggtatccataacacacacaggcatcccatccttgcagacagttcacacatggatgtgtgatccagtggcaggtctcaagaaaggaaagcttccaaagccaggagcttgactgagacagagccttgaggtcttggactggatctcccttccaggtacacactagaggcaggcagcttccttgtttcttcctctgctctggctgctgtttcattctaagcctctgcagacacattcttcatagctgagaaaactcacagatggaatgactattattggtgcttgtcaatccagaaataaaccacaatttgctcggcatttcaatctttaccactgatgtgttagtttcatttaattagttctgtgctggatgaggtcattagatttgcgtcctaatggaaacctattactcagctctgcatggtgaggagtgtgtaggactgatttgcattatctctggaaagaaggtgaattctctcactacatttgtggtgggcagcaggtcttccagcagaaacccatttgagataacactaattgaagggacacctgtcttttgagaattcttttaaaattttcatagcagattggctgtatgccctgagaaaagggtaaaaagtgtgctacttataaaacgcaattttggagaaaagatgtagtatgatagctaaaactgttacatgaatatcactgagtattttttaagctcttcctcttagaaccaaatttgaacaaattcttcccacacgttcttctagagttcacaaaatggaaagtggaaagtagaaatgaaaccacacctgtttccctcctggagtgagccctcattgaatctctgtagtagtgcctataagagtgcttttattttacaggggtactattatcattttcctttttcagaggagaaaactgaggcttcacactgtgagacctgaggcttcaagttactgaatattttgctcaagtcattgcttgtatcaaatggaacagatggaccccaaacccagtgtggctggtctgaaactttcctctttgtttttatactgcatcaaaaacagtttttcttgccctgatagaatctatgccacttaattctcaaaaccctgtcttcatcacatcccaccattctgaaatattcaccttcccttacaagataccaccatttgaaaatcgcaaaatatttttaaatctatcctctttcttatatattttttatcaagattccttctctggattctggccgtattatgaaaacagcaggtccaagtgtcattgggccaatgtaaaattgtgttgctgtattaagacatggacctaatgatcctggaaagctgagtgggtttagttatgttttgttttctttcctgtctaggacatcatgcaaagctagactacaagaaccagggattgatttcagtgtttctctgggggatggggtaatgggggatagatggtaagtctataatcaagaccatctctaaggaagaggattgatactctttccacgggtgacactgcattattttccatgtaaatggtgccccaagagtactatgggcagtcttgttgcagatctatttcatcttcctttcccctgccctcacctccctgctatttattgtttcccttcactgtcaaattctctgaaacattgtctgtattcaccgtgactcctttgcaatgcactttcactgcaatcctttaaaaaagtttgtcttcctcctacatttttctgataccactttctctgagaaattcaatgtataaatctaccagctcaggaatcccttcttaatttttctctgagactagtcactattttatccactctttctagaagttcacttctttctttatttttcagtttcactttagcctctaataggaggtggttgtctaagggccttgaggaggctgagcttgcacagtgatagttaattcttgttagtggctctccctctctagttcagcatatgctttcttttcctttctcataagtggaaacagtcataatgttctgctgttggatgtttcctggaaaagtctttggagagtttctcttcttctaagatttcagctaatgcactatgtggtatacagcttatctgtatctccagcctccacctctctcaagctctggccttccattggtcactcagtactcactgatcatctccatctagaaagccctgtggtaacccagagtcagccgaaatgaagacaagctcttcatctctctaaatatatttttgactctttatctgtagtctactaacttcatcatctatgcactagatagtagattgaaccagctgtaaactatgtctactagttttgtgcagtggttctcaaacttcagcgggatcaagaccactgtcatgatagcacacattgctaggtcccccttgagaagtttctgcttcagaaggtctggggtgaatcctgacaatttcatttctaacaaggtcccaggtaatgctgatgctgctggtccaaggaccacactttgaaagacacggatttcctgcacaagtctggagccagattgagttaggcttaaatcctaactcagccatgtgcttcatgtatgaatcttggcaaacttacatgaagtctctctgattcctcttctgtaaaatggggacgattaaagtatctacctcatagattttcttgtaaaaacgacatgagtatataagcaaagtgcttccaacagtttttggcagaccctcaaaaactgttagctataattgcacagcgtttactctctctgctttccttgtcctcactcccaacaaccaatcagctctcatgtcctaacagtctgcactctggaatacatccatttccttttcattattgctgtggatgggattaagtgtgtaatcacattgtcattcccctcactctactcatggtcatttaactgattggaactgtcactctctatccctgcttccccagacctcatactgttgtcaggttctaccttaatcactttaaagcaatcattacaaataggtcccttccttgcttagaaagtgaatgttgagtatattaatagggtatttgggactttccttgtactgagggcacctgggctgtctatgcatttcctctcatagcattcatgatatggaatctatgtttttgtaaatgtacctctttgctttcctgcttctgtaattttttacattatattcatttcttttgatatatactccccttcactattacaaggcagagtcttaattcattcttcaaggcctggtcaactttcctttgcccttccgaaggtatagcaaaatggtttcattcctcatgagaatgctgactgattgatggtagctgcttagagagatgacaagaattctggggccacatctacctgtgttcaatcacaaataatatcatggccagtgagcagtatctactgtagacacaggttaaatgcatggatgcatctgtaacaagtattgtctcttacgccatggagtacattttatactgtggatgcccaatgcattttggaaatctcacaactcagtaggcataacctgaattgtcaatgtgagtttcattttgattatgatagctaattttcccttcttcattccaggatgagggtgagaccttatctcagagaatgatattgccagccagaaaatcataataggcaatgaaaataagcctttaccaccttagttcgagaaagcaatatttggaacagggaaaatatattggttgtattggtggctacaggcttaggggtgaggtcttgggttttgaggtatagggaaccagaagaaagaataaggggatattctcccacaaggataaagaaaatcagagggttcttgggaatagctatttatagaggacttccatcatggagaactcctgattttacatgtgcaaggtagaaaagtgataaattccagctctgccacctatgagctatgtaattgggcaggtagttaactttttttgagcttcaacactattatcttaaaaacagaaatcatgatgctacctatcagggcgattgcaaaaattaaaggaaaacatatataaaacactttgtataatatctgactcaataattggttgttgttcttatgaatgttgtatggaataacaatcaagaaaatccccttaaaggtgttaaaactctttgcctcttatcccatattcctatattcaccgttagttatacacacataatgtcatgaagtgtctaaacaatactacaactactaactaattaactctaattgattggaactgtgtaagcaatactgctggtttactgttttcctgcaccaactagcatgagttgatgctgtgaaggtagagttttggtgctgctgtcatatttaatgcattcaaatttaaaagagaaacagcatgaatattacttagaaattcatacctttctaaggaagtttactctcttagattatcacactttataccttagatattttggcttatcttgttcttttcctgatgatgttattaaataccttgaaacacatgggttcataaatattgtaatttattcgttcaacaaatatttttggatgtttcatggggccaaggttctattctagatatcagagacataactgtgtacaaaacatataaacctactattctactggagattatcttctggagatagaatttagacactcaacaagtgagcaaacaaacaaccatgctgcaattttagatgttgacattttctctaaagaaaataagatgatggagtagagatgaccatggtagggtttgggtaatcatttttgaattgtggcgagagctttggccacatttgaattgatacctgcatgatgataaaggatgaagcaagaaaaaaatgtgaattctgagtcctctaagcagcgagaaaagcaagtgatccaactggcataaggactgaaagaagggccagttggtagctaccaggagtttggaaaggagtgttaaaaatcagtgctggaggggctggctgcgctgatcctggagggtgctggaagtcacctagggagtttggaattgcttgggtgcaagagaagccagtgaaacataaagatggtagcaagaaaaataaatttgattttccaagtgtacatgaacactgaatgcctgtagatctaaccttataaagaatttggtggctatttatgtagatgaagtggatactcacctgtgatttgttttctagattcaaattttctcccattgaaaaagcacagggtttacgcctttctactttgttgttcctgaattcaaaaacttttgagttcgtttttaatatattccatgacatattcatgtcatcctgttctctgacaataattttcagtgtggccctgatctgctacattatttatttctttctctttcccaaagctatcttgtgtcctctttgtatttctgtcttttatggacctgagaagatattaacgtagagattttgataaattgcctctgctgtccttggattacttcactttcctttagaaggctcgctatggccttaaaactgtgggcctgtttaaggttattaattcgttccagttcttggggagagcagcatgagcctctgcatgtatcatctggttgaatattctaacaatttaacaattgtcttttcgtctcttgtcccccacactttcaagttggggttgtcttttaacttcactcatagacttggacattcccttccatttcaaatagatgtttccaactcttgtgttatttctcttcttttattatatttgctgtatctacatattttttcaagagctgtacattactcttgactgttctaaattggcatgcctttatgttgacctcctgatcttcacctgtatacattatttgtcccaaggctttgattggctgcttagtcacattgagcacattcgctgaagctctaaagactcttctgtagagtcgacaactgtgtcagttctgtgtatctagtgccagaaaagtacaagggtgatgttttattcatactttgtgctttccttcacaatgacttgttaatttatttttaagttttcttaaatagttacattatttttatatgattcaagattttgaaaacattttttaaaatttaaaatggatatgattgaatttaattataacccacagaattttaatgggccatttgaaattgcaataattgaagaaaatgtttcaaaaatattttgagtgagcttttgaagtctctaacatacagtatatataatatccattttaaaaaattttcttaatgtgttgataatatgtggtttcttttacgaaaatactgtttttcatataaattcctagggagaactttgaaagaataatagtgattaaggaaagcatttaaataagaattaacccaaaagtagaagaaaatcagttaataaaaaacctagtcagagaaaaaatgccacaagttgtttttttcttctttgaaagaactttgatgatattctttcatttccccagccccagaaagaacaaagcttgtaggcgatgactgtgagccagacgaatcttgaaactctttgctcattcctcccaagtatcattcacctacaaatacataacttaattctatgcttctatttggaagagggaagctttaaaattattgcaaacgttcttgcaacggatccagttgcgcctgcctcattttccacctcctacgatgattatgatttcagagtggatttcagaggagaaagaatacatttctcagaaatgtcacttttattttaaaattaaaaaaatcatttctagatgttgcaattaatataaaataacccttcaagaatcataaaaagagaacactgacaaattttctgcaaatgaatgtgaaaaaattttagcatagcaaaatatggtggcagagtgtctacaaagttttcttcccatgctcatagaaacttcactgaaaattcaagactggctggaagattgagtgaactaaaaacctgcaaccttcttctaattctgaattctcatattaaaagaagaattagttgtcagatctagaatgattattagcctttattgctgctttcttcttaaaattttcacagtaagtagtttatttctgaataaaaatgaatgaaaattgctataatctattgtgtttggttattttatgaacaataatatgaatatgatgagaagtgtaagttacaaaaagagaccaagtcaaaatttaagaaacatttcattcataccatttatttagaaacactttctaattaattgaacactttattttaaagcccttggtgctgttagggaactgtaaccaagtccaaactggtaattagtaaaaatattaaaaactaaaattttaaattatttctcaagtggattcattttgttgtccctatgtttttgcatactatagtggtatttcatagggttatttcatcgtcccattaaaactatgctgcagtttccattcattacctcacttgatcagacaagacagaataaacctcttgcccaaagcacccaactagaaagggtgggagctgcccaattccaaacttcatgccttccacttagactagactctgcttcctctctctgaactcagttttcttggactgctagccttttccttttgtggaatattttctctgcctccatctagagtgtcatatgtagtttcctatatggtgaaaaataaaataattcaaaaaatgaaaggaaggttttaaagctccaatacagctttgaatccaataacctaacaatgaatataaacttttctatgatttaaaaagtatacttgtacatctattctttagattatcaatgttgtttagtgtaggtaatgcagatgctcagtctaccatcttgaattagaagcaacttatttattgcttaccagaatctttcctgagttgccaagagcatagagttaggaaattttgtaaacgtttaccttggacagtatctccttaggctgaaattacagtaggtggacagtaacaatatgatctttattttagttctttgatattggaatatgaattttctagaagggtcaaggcacttacatgacctaaaaaattagactctatttgttaataagagtctaacttatttcaaagcaaaaggccagtgaaggatcctcagggctggattaatgtgattttcagcacagagtgatgatggcaattatggtttccaaagcctgggagctgtgtgttttcagatgttggagagggaattgtttggaattcccaattccaaatgatttccctattgtttggagccagtagaaatactgactcttgtcagtatatttatttacaaagctcttgatgtatgcccactttaaagaattaactttcaaaaatcttaaagatataattggagtaagtttgttatatatgaagaaaaaataattctaagagttagaatataaaatgtgcagaatgtaactgtgcttttactttaagtttaggaggaaaacctaaacataacacattcttccaatgatattatgaatcatgtatgtcctgtcaaagaaaatgatcacttaatatgtgatattattaatgctttaatatgcaaatattctgcaaatgtcagtaactgaaggaaggagataaaatagtccttcaaaagttgaacatactcatacatactgtgcataggacacaattttaaataagattacgacctattcatttaatgacaacaataagttcgttttattcatcaataattcattttccaaagtacatatcatggctaaatattatttgaacataatggatacacacgagtaattgtcctgaattcctatataaatctattaacacaaagtagtaatgtaaacagtaaatacactacaaatacctgttcaagaatggccacactcttttaaaatattcatatattttgcatttagtttaaatgaaatctcattctacaaaatttgaataaactggctctaaaatgtacttcttattctcaattagaaatatagttcatgaaaagtgatttgtaaaaactgaaggaaaaggaatttttgtgttttcataagttattgtataattggctgacatgtttataaatccctttctccaggaagatgtaaaggaactcaacagaccaggttaacctgattcttctttgcattgtcacaaagaaatgaaacacagaattaaataaaataatgcaaccaatgttttaaatttttgcagtaaagaggtcaaaggagctcatctttaaatagaaataagcaccatagttttattctaactgcatagataacaatatataacttgtagaacataattttatgagttggtttggtggacaaatgtgtaattcttcttatgtggtcttatgtgggaccattcaggacaaaaaatgacatactgatctttatatttgcaatgcttaccatgtaatacacactcaaaatactttttaattgaacttcgtgtgtgtatagcacagaaaacttatcaaaccttaaaatgtagcagttaaaaaagatagtacatttccttccttagcattaggttaaattttaaactgttttaatttcctgaagtgtcttataaacttttagaattacaaaaaaatgtggtttttaataaaatatttttctccctcattattgaagacgatgttaccatacaactgagatggtttaaacttcagatgctccatagcagatatttgttttttactttctttcatgtcaggctgcttctttcaaattggtcattactagacattttcattgcaataatatttattatttttatgtcttttgaagcctttaacccagaaaggcctctaagtacgttttggatcataaaataaatggaaaaatctttaatcttaaataatcattagtttagcaaatatttctgttgatggttttcactggaacagagcttgctgatatgattgtaagtgtaggataaggccacccagttcagataattctcttccagagtaggacttctaagttggaaaacaataaagactataaggttgtttaaaaccatgcttattttacttatagataattcaggcattgacatatgtattatgtcatttgcaaatgatcattaagaatctctacttgggggatagataataataatcatatctttctcaataagggaatatggtaaaattccagatttagtagtggctaatgtaacctccttttcatggctctattcatgcctcattcctttcctatcatcctccatctaggtcactagcccttgttggagaatattgtatcctattgctccgtgctggtctgcttacctcatggccttaatattgttatgaccttgcaggaagctctcagtattctgtctaaagttgctcaaataatgtttaaatgtgcaatgtttatgctttagctggattccagccacagtgagtaacaagatccacatttttttcttcaccagaattccaggaagtggcatagtatccctctgagggaagcagtgagaaaaatggattggtctaccctcctcagcctttggagagctttggaggagtcaataagatgatagacttgatgttatgaaatgtgatttcttgccataatacttctcatcttcagtaacttcaaatatcaccacacactacacatctttgaggccaaagaaggaggaggtggaattcccttaccacacatatgtaagcagagatgaataggacaaaaattgatgaacgttttggggatggaccaaaacttgcccatcttttgaaatcacgatttacactaaaattagctaaacctccaagaaaatgaacagttacaagtgatggactacatatttttttttaaagcgttcttggtttctttcatttgactgcatgacactataaaatcacacaagctaagaccaggagaaggtgcgtgcagatgtgcttctgacttcttgaagacctacacatcttgctgaggaattctttgcttctttagtgagtggtgctgaatggaatgttagggctcctatagctataggggaaggttattttggggttattagtgatacctggtagctgattcctgattactctctcagactgtcttccctgtttcctctcttctgttgaaaatgttctctggcaggatgatttctgtcaataagagcaattggctttcctcgtcgaggttcgtgcaaacagaattgaaaaaagctgagtgagtgggcaggtttttgctggtttgtttaacaatgatttgagaactgaaactagagctgtctgaaataataaacaggtttctcagtgactggaagagaatggtgttttgttctttgttctggtccttttctcttttgacagtcctatatccttgactgttttcatggctctgtattctatacatggcctggaaatttgactgagggtctcatagctaaaaagtattagaagtcgtggccacctcctcacggagctctcttatttcctcttcgccttgacaacttctgtatttgctttaggtctgaactggaagttgcttccaggcttatcgcccaggtgagttaggtgtctgcttcggtttcctcacacagtattgtcctatgtgcttcttttacgatattgcacagcacatgttattacagtcatttcttcaacgtttgcttcctcatgggactgtgagttgtgtggatacaggagtcatagctactttgcttattgctgatctgacagaacctaactcaatgcccagtagagaaggtctcataaatagtcatttcacaggaagaaatggatttatttttggagatgtcattaccaaataaagccttctaggcagcagcgcccatgctggccatttgactcaaactgtgctgagggaagtatcccctggccttggaagatgagtgtcattttgattccagctctccaggtttttcatcaatgtcagcacctgctgaaaagaaccatcaaactggcactactgctgacttgtttgcaatccttttttaaagtttacctaaaaagaaaccataaaaagcccatcagattgtttttccaaaatccacatagacaataaaggcatttatctaaataatgttttggcttcacataacatcaataaacacttcatgaagattaaactgactgaaaaccttttatacttgtcaactgatttctgttggctgagttgattttctttataaagaatttaaaaagtaaagttgttttgcattaatgcacttagggatgtgtaaatgattttccttaaatcacatttttctgacaacgaacacggagtgaaagattattaaaactgatttctcatgaagttgtttgcatacctcaaacaaatatgtgaggctgtctccatcagtgaatgccatgtgttgatgtgattgatgaattataattaaccttggcaacatgttttacagcttaactttaaggatcaatcgaaattagttattctgaaagtcagtaaaatcgcttctatcctcagcttactgcaataagtaatggcctttctctggaagagttcttaaaatatagtgaacaaatacttagctattgaatctactttttaaaataaatgagagaccaatgggattggaataacttaatttgaaggagagaagtctccaggctgatttagtggctgttctatcaggagtttccagtgggcagggggatcagttctgattaacagttgaggcagttacctaattaaaacagggtgtatgaaagtaagggaagtgggatagtaggggtcagacatctaagaacctctcttccccctatccaatcaaagagaaaagctgaaaaaaatctttattttctgaatgtatatttaatgaaggtggagccatgtataacactaacattatagagtgatattaaatagggcacaagatatagatcacttaaaacaggtgggttcccttaggctcagcatatcaagtgacaattttttttttggtgtgctgccaactggcagagccttttgacaaatgtgatggaccttggaaaaatgataaatgtcttgaccttggaaaatccccttttggaagactttgtcctaaatgcttattcattataccctacagtaatcactgtcaaatatcaaaagatgactccttttatagctcgtgcaaagcttaaatactttagaacatgactgaagatgaccaaacacactctccagaaagttttagtcacctgaccatagcccctatgtttttgatggtcattgtaggcatttggaggtatcactttggacactctccttgaccttttctccgcaaggtctgtcatctccatttagactacacaaaataacgtaacttctctactcactcatcctgcatatcctctgctcccagtagggctctcaataaggcaattacttatctctgtattagcaagggggactctaattgcacctttgcatgaagcatgggcaattaactaaagggaagttgaagctttagtaactctccaatggcaatccatcctgtcctgtgccagcatggccacccagagcagacccatgcctgctttctgcggggggatgtgggatgtttggtcccagaaatattaaaaattactggtgttatctcataattgtagcctgattaaatagatcttattttttgttctatcttttgtgcaaaatggcccttgtacagaaattttctgagatactgaactatggaaataaccctgggattacattggtacttttctggactggaagacttggagtgacatgctgcaatttttaccaagttttgaatagatcatatggcttattttcttttaaatacttgcattgccgtagtgtaggttcctgagctaatttccgtctgggatgaggtatggtcttctgatgtccagtcatgggtccagatggtgatggtaagaaagatagcatgattgctgaatggcatacagaaggaaacagaatttatccctagtaaagagatggataggaacttactagaacaacaggatatcctcttgtgattaggagaggaggtattactcttcagcaaagacctggggtactagataagatgtattggcccggaggaaacaacagaagaagaaatctgttgcacagttaagctgctgtggttggtggttggtgaggatggagaggaatgtggggatggggtggaactgactccagggactcttttaataagactcaacgtaattcaacatgcagcttgcatgaggaggacagggacactccagtggctcctgtaattgagtcctgacagtgaatctaaattccattttacaccaagaaagtctagatggagccagaggtgctttccctgatatggccagatatgagaatcaagggagggcagaggaagatggagagagtgtgccctggcagctatcatctcatattctctggactttgtatttcccttgccccatgtcaggttttgtttgtttgtttgtttttgtctgtatcagtttttaattcatttttacattattcattgaatatattcatagagaaaggattgacagtagacatggctatttgttggatttcttctgtattttatatgtagccttttggtaacaagcaaggtggacatcctttgttttatttcacctaatcctaatactatgtattccaagcctgtgcttatatggctgtgggtctcaaactcatatatctacagaagtcaagcagaaatgtaaatcaggagcaggatagtgggggctgtgtccagctgaaggctgcttgcccagtctaatgaaactgatctagaggaggttgttctagccattttttctagaagtggacacatacgaggcagataactagattgttttaaagaaacattttaattttgaaaacattacatttatttatttatttatttatttatttatttatttatttattattttgtaatctggagggtttagctgacctctgggccaccaattcacctgcactgatgtgattgggagccagtgagagttgtggatctgtgtcttgaaaagtcacttcctttatgctagtgtagacccatcagtagtaggtcacctggaagccagggctctgcgtaggactcagggcagcaggactgaaagttgtgtaacacagcagttaaaaggagggctcaggaccagaatgcctgtgcttgaattccagtccagctactaaccagccatgtgaccagccaagttgatttatgcttctagcctcggtttcctcatgtaaaaagtggagaaaatataagtatgtgtttcacaaggttgttgtgatgattaaatgagttaatgcaaattagcgacaaaggtatgtatgcatcctcactgttaggaacgagggagcaagatgggacatggtggtcccctgagtcgcagtcagtgaggcagctgtgtccatgcctgtgggatgcttttccactagcacctccacaaaatttttaattcgaagggtaggatgagggatctgagattttaaaacacctcccaggtgacttctgcaagaaacacctgcagaggagagagagcttggtcactggggtccgatcctggccccggtgtttactaacagtgttgccttgggctgatgactcatcccaatctctttggtttccaaacgttcactaatgcgatctgctctgtgaggctgatcatctggcagagctcatggcacttaacacagactctacaacacgagttctcctgtcttctcggtcttaatctagtgcaagtctccccaccaagacttgggaaacactcctaaggaaacaaagaggaagaaagtgagatcccaggggtgaagattggatcctttgtgtgcttagttctgaagtggaatcaaatcacttcagaagttggttgtgtgttggcctctggtgaatttgtttcacaatgccatgtaggagtacatccgtggcttctcatatttgtttgcctaactataattgagcagcttgaattcaggctacatttttaaagaaaactagtgatcatattcacatatgatgctctggcagtacacagagtcaagttttcactggaaaatagctattaaaacccagcaatgtaagttttcctatgcaaccttgatttattattttgtcaaatatagttcaacctatatatagccagttaggagcaaaggtgtagggtaggaaatctctagctcggttcctatagtatccaacattctataagaaaacatgcacacacttatcaacaggttttcaataatgaaggcaccatacaacccatgataattatactaaatatactgatgcttatgattttctcatgctgtgtatctggaaggagcctggtgtccagcctcatactgggtcatggaagtagcctgttgtgtctccgtgttctaccatttatcacagggcatcatttctgcatctcgagtcccaattcacaaaattgaaagatctctcaggcctgagcctattgttgttttatctttgaatttttgacaacccagaacatgccacatttcaggaaaggtttcttgaatgagtgcataaatgaagctttgataatgatttgacatttcagcatcttctggtttgctcgtagtttgctaaggaggaaaatgaaaagagagaaagttagagagagcattgcgagcattgcgatttccaggatatacttttataatgagttgttccaatacagactgcaagctcagaactttgaattaactggcacccattgtatgccacctgatgttagtgacaaatgtacccacttcagaacaggagccaatatctgcgtatcagggagctgcagagatgacagtgaaaaggtacatggcaagtgatgaatggtcagatgctaatgccagcaagccctttgctacagagatggagagtttaattgttcccactttgatttcataccgcagacgccataaacatcttagtttaatcaaccagaaacatgggctgtcatagatttaaattcatagcagttatgggtctatatcaaaagctatagagatgcttgttacacacagatacaagaacaggaatggaaagcactgatgtcatccccatgggttaaactggactatctgtctatttttcctgcagggtgaggagtttattaacaagaaacagtgtttatcatactaggcattcagataaatccattttccatttaatttattcatttggaaaggtcaacttttccaccaaaacaatttctgtttctttaatgatttctttaataactttctgtatttttgtttgtatttctcttctctcatttaaaaaaatctcttttcaatatgccaatttaattttagcacacctaatacaaatggcattgaaaaacaggtttcttgagtgtctttttttctttttaaaattattctcatcacttcaccttaggatgttttgtaagcgcatcacatgtgtttcatgtgaacctcactcagtactggatctttttctttccatttacatcctaggaagttattgtttcccattccaatactgtatgcatttttctttcctaattggcgcttgctagtagacagaaaaacattacgtttaaaatccatttggctttaaattaatattttagctgtatctgaattatcccatgaggccatatttatcttggaaaacagattgtggttaaactcctgtttctaacttttatttgtttggctgatgccatctttctgttcagaaaaggagttagggcagttgtctccttccactaggccttgaatagcaaatgtttagccccgagcaaaaaaacataactgccttctgagatgtttcaggctttcattcatgctgtagatgctaattttggaggaagacagaagcttatattcacacagttactaaaagagcacctgggtcagggggtggagactcggtttaccaagttcttaaaagacaacatggctcttctgacttcagcagataaagaggaatcggggcattttcattcctggatcaatcccacttcttgttcatatggtctgtttattgcaccagccattaaccaaacttatgataggaaagtgcagctagtttttcaaaataatgttttaagtcttctttttaaaaaataaccaattcccccaggatataatagtctaattaataaactgatgaatgttataatccattagacagcattatcccgagatggaagggataggtattatttaataggaatgtccagagcagagtttatcagtactttcttgtcacatgaaagtacagttcctggctcagaacacacgccaaggctggtggccagagggaagaaagaagggaagaaaggagggaaacagttgaagccactggctgctttcttctcaagagcatgctttctgttcaaagcacttagtatgtttgcctccaaattctgaactcctatgacttcctgctaaagcactcaccttctttttatttagctttccaaccacaagtcagagctgccctacctcagaatagagcttctttattccttcaaattcccaagtttatttacatggaaggggcatactgctcttgttagaagaatattaagaatatccttgaggttcccaagaattgtacaaataactgttgattctttggtgatagacattctgattttcaacatagaatggctatgcagagtagagggtgtctgttatgtgttgattctacaaacagaagaactaaatccacctgtgtgttcagttttttatacctttatgtcctttatattcccaatgggggtgaggagcgcaggtaggaagggtaagagtctaagaaattgtgctaaaaactcataagcttttggtttcaaaatgatttggcaaaggaattttatcctgagggacctgagtttggggtaagttttaaaggaaaatagtgaaaaagtagcaactatagattattagttacatttaacatttcatgatgggatggtggtgtgtgtgtatgttgacacataatgtgtatgtgtatatgtgtttgtgtgtggatatatgtaggtgtgagtgtttaaggtgggagtcttttgactccagcttttatcattgaatgcaaagggcagaggaaaattcacacagataattcgaagtttgaacatttatattttttgtctttatatctcatattcctaacatgggtaacaatgtgcagacaatttaattcttttatcctcagatataagcatttatttatttttatttacttatttacttattttgagatggagtctcgctctgtcacccagactggagtgcagtggcatgatctcggctcactgcaacctctgcttcccaggttcaagcgattcttctgcctcagcctcccaagtagctgggactacaggaatgtgccaccatgcccggctcacttttgtatttttagtagagatggggtttcaccatattggccaggctggtttcgaactcctgacctcgtgatctgcccacctcggccttccaaagtgctgggattacaggcgtgagccaccgtgcccagttagatataaccatttcttataggaagacacaatctttgttgaagaatactttgaaagaactgcattaaggaaatcctgatctgggactcagggtgtggcacctagggagcaagtgagaagagttaattaaagtactgttatagcaacagaactgggcagtaggaactgcaatgtcactgagaagaggaaggaggataatagctggctgatagagtttgatatgtgtccccatcaaatctcatgttgaattgtaattcccagtattggaggtggggcctggtgaggggtgtttgggtcatggggcaggtccctcatggcttggttctgtcccggtgatactgagtaagttctcatgggatctggatgtttaaaagtgtggcccctgccccacaagtgctcttgtgcctgttttcgcctgtgacttgcctgcttcctgtttgttttctgccatgggtaaaagctccctgaggcctccccagaagccgggctgatgccagtaccatgcttcctatacagcctgcagaactgtgagccaattaaacctcttttctttgtaaattacccagtctcagatatttctttatagcaatgcaagaatggcctaacactcagggtgagcatgaacaagcagggagggtcaaagaagaggaggtctttggtaggagtatgggtcagggagtggggtgagggtgggcagcatcttggaagagggtagataatgcttctctgagatttctaaaatatctttagtttttattgttcatgatctttcttataagagaattatttttggtagactcaaattcaagctgtgttctgggttcaggctggcacagattaaaaactgaagctggtgaaggagtggccacagctggagggaccactgggattctgttttcttgagactttggtcccgacctatatggtgaccattggtccaacataggttgggaccaaattctcaagaaaccagaagacatggttcctccctcaggttgctcacagcatgccatccagtggtcccttgttgatcatgattatcgggagtaaattctgtgtcaacaaagttgacctggctatatttaattcacccccaaatcaaggccagtactcaagtcattttagtaaatttctgtggatgcagtactacagatatgtgattataaggggagccccgatggggtcccatttattcctttatgattaccaggagaattgaaaggcagatctttttttgatgaatgtgaatttctcttactatctgaattgtggagcccaattccattcaaataaattatctatagatttactgaatagggaaaataattttactgtttattgagaggctgttgtatgctacccttttcacttacattaatttatttaatattcacaactctcctgagtggctattataattcttattttattactgaagaaactgaggattagagaggttaagtaatttactcggtattattcggttagtaaatgggaagggcgcaaagctcagaggtgtgtatggaaaagacattgtttttcctgggctgtagagggctggaagtgctttcactgaggctcaggcagtaggagccgggcagcaaggaggaggcagcctgaacatgggccaggatgctgtgccgtgtgggatgtgttcactcagtcaacaaacatttattgagtgcctaccacatgccaggcaagtaggcaaggtatgcctaccacataccacatactgctccaagtagggtggataaaaaagtgaacaaaagaaatcctctagaactcacgatccagtggaatgatgctgtcacaaatgcaatgacactgactcaatggtttgcagcagcacccagaccatctattgttgaggggtttgacattccttctgatgactggcacatcggagcatgctgacttatctgcctacacactgtgttgtgaaacacacgattgtgagatggctcatgagtaatttgtcacattcctacgtatcagaactggtcaacctataaatccacgtttggtcactttagcattaatagacatgctgtaatgactgctggacttgggcacctcttcccaccttggacaatgatttgtaagcacctgtatctttagtagaagtgctgccacttccatccttgatggccttgatggcatctttccaggagcactgttctcttctaagtccatgctgctccctgtacttcttggcttttctgtggtataaggtcccagggagggtaggacattgactttttctctaactctttgctttagtttctaaacctttgtctttgacttcgctttctgattccacccttcacgccatcagctctagagacaaaggtaacaggacaaagaatcagggaatgaggtgagtagtacctgtctctctgtcccccttttctccccctcctcaggcaaaatcccttccctccttcagctgcaatgagacatcagaaagggccaacgacttactagttatcttgtgatccatttaggaaaagagcaaagtaattgcaccatggttagaatactcagtatataaacaagaattcaagttctaatatctgcgatagacttattaaagaaagaaataatagtagattagattgaagtttatccttataataacttgtctcttgctctcttgcattcacatttgttttcttgagatgagataaaagatttaatttactgagaatttgttatgtatgaaaataatattcatttcctccagcctttcaatttttttgtcacgaagttttgtataatatatacctttatagacatattttcatcttttctacatatgtgggaatgccaaatgaaagccatttttcctcaatataacatttttaacaagagttcttaaaataatgattccccagttaatgtatacatatacatttgcaaaatagcaagttcatttggtaattgcagaagaaataatggctttaataaccactgctccacttggtgtctgcctctaagcattgttaggacagcaagcatcaggcaattccccatggccctgttttctgagaaggttctatttatgtcttccgaattttgactatattttgacattttcaagtaagtgtatggcatctgttgaataaatgatcactcaaaatggatttgcctcaattatcacctaggctttaatctctctaactacaaactcccccttcctcactgttgctggcagtgacacctgcattcctgctgcaccgtcatccttgggaagggctttggagttgcaatcagcatccttaagagaagagtacttaggtgtagtatgctttggctgttctcataagtcgttattggtcagcctgaagcctcactgttacaattactttgtctaattatgatttttgctgtcaaacttatgttaaaatttcagcaataacagtttatttgttcagtgctctcactgcattataaacatgaagttttcacattttgtatgttttagtaatcatgaatgactttctagtattgtccacattatatatttgatatctatttatactgcgaattaacactgaaacaatgaactaacgtgattttcttgaagacaacacattgtgttcagttggttctctgaaccctaaataaagctgaaaagtgtattaattttggtatggattccctaatgattgcacagttacttgtatatattttatagctgtaaatcttggtggataaactagaattagcagtgctcaatgacttcaaatgattttttttttttttgagatggagtctctctctgtcacccaggctagagtgcagtggcgcgatctcggctcactgcaacctccgcctcctgggttcacaccatctcctgcctcagcctcccgagtagctgggactacaggcatccaccaccacgcctggctaattttttttttttttgtatttttttagtagagacggggtttcaccatgttagccaggatggtctcgatctcctgacatcgtgatctgcccgcctcggcctaccaaagtgctgggattacaggcgtgagccaccgcacccagctgacttcaaataattttaaagattatacacacacacaaacacacacacatacacattatttttcttttgaactgaaataacacctggtttcaattgttatacatgttttctcagctagtgctattgcagttgaaccataatatatataaagacaatatgtggatcctagaggtaataaattatttcagcaaggttgtagagtacaagattaacaacacacacacacacacacgcacgcaccagtcacatttttatatactgaaaatgaacagggaaacaaaaattaaaaatgcaatagtatttataattactccagaggaaaagacgtgattagatgtaaactttaaaaaacataatctgtacatactgaaaatttaaaaatgctgacaaaagaaataaaaaacatcttaaataattggagagacatatggtgttcatgtactggaagtctcacatagtaaagatgttaattctcctgaaattgatagtcattcctataaaaatcttagcaagatcttttgtagataagcttattgtaaaaggtgcatgacagatcctagaatagttaaaacaatgttgaaaaataataaagtgggaagaattactttgctgaatattaagcttattatagaactacagtaattaagacaatttggcagcgagagagacacaaatcagttggacagaatagaaattctttaaatagattcacaccaatttgcccacatgatttttgacaaaggcacaaaagcaattcaatgcatgcaggatacaagtttcaacaaatggtcctggagcagtcagatattcataaggaaaaacaatcaaacaaacaaaaaacccaactgaacctccacataaacctcacaccttatataaaaatcaactcaaaatgaattatcggctggaaacataaagctataaaacttttaagaaagaaatacaagagaaaatttctgggatctagcattcaacaaagtgttcttaaacttgacaccagactcaatacataaagggaaatgttgatgaagtctactttatcaaaatttaaaatgcttgtctgagaatgagcttgttaaaagaatgaaaaaacaaagtaaagactgggggaaaatatttgcaaaccacatatctgatgaagaataagtatttagaatatataacacagtctcaaaactcaacagttaaaacgatcccattaaaaatatggaccaaacacattgagagacatttccccaaactgaatatagagagagcaaataagcacatgaaaagatgttgaacattattatcattaggggaatgcaaataaaaaccacaattgatatcaatatatagctatcataatggctaaagttaaaaaaaaagaaaaaaggaagtagtgacaacaccaaattctgacaggcatgcagagaaactggacctctgaaacatggctggtggaaatatatttggtacaaccactctggaaaacagtttgccaatttctttaaaaaaacctatccatgcaaatatcatatgacacagtacttgcactcttgcatattaacccctgaaaaataaaaagaatattcacatagaaacctctacttaaatgttcatagcagctatagtcagactaaccaaaaattaaaaacaacctagttgttctctggttgttctttggcaggtgataattaaacacactgtggcacatgtatattgtagaatactactcaataaaataatgaactgttgatacagtcaacaacttaaataaacctagatggaattaatgctaaatttatcaagccaattttaaaaggtcacatacttcatggcaccatttatataacgttcttgaaatgaccaaaatatagaaatggaaaacaatgtgtagtttccagggtttaggcaagagttcagagtgggagggaagtgaggaagcttataagagggatccttatggtgaaggaatattctgcatcttgagggtgtcaatgtcaacagctttcttgtgacactgcattatagttgtgtaagatattacctttgggagaactaggtagagctacatgggatcagtctattatttcttgcggctgcatgtcaatctgcaattatctcaaaataaaaaattgaattcagacaaaagaaacaatacatggaggaggcttttggcccctgtgggagtgctctcttgattctcctgttagagagagaactgtcttttcaggtacaagatgggctcctcagcctccgtcccagatggtctacgttgagttcaattttttgttaagtcaagaagatctgtacttagacggcagtataaatacttggcagacactgcaaaaatgacctcagtacatacaatatttgtcagaaagcttgcttggtatcagcattgttcagaaaaaaaaatacttgaagaccacaattctaaaaacttatctctagagcaagcctagagaggagagaactgagtgcctaagttcaattattattgagccatcatgaaattgtgtttacagaatcacactttggtgatcctagaagaaatatcttcctttagtcaaagaatgataaaatttctctgaggcattaaatttcctatgggaattgtgaattatatgaccaatttttctccttctcttaggctactgaaattctacagctaatttgatttattctgtagcaatgtgggggtcattatatatgattgttcaggcatgaccaactatttttccttggttccccatcttacctttaattaatgtatcttgttaaagtttctgagtctttagaagctgccttaaatctctatgtgaataaataaggaataaagataaatttatcttgatgtacctgcttcagcctcttaatatctcgtaattgcataggactgtcctggaagcatattgaaaaattaaaacaaaaaaagacttctatttctggaatttttctatgcctccttcaaccttgtatttagcaagcatatttttgcaatttttttttctttctctatcttgacttcctctctcttgttagccctctgatgaatgggccagtttgaatttgctactctggtttttggcctttgacaacctgccagcaaatgccccgcttgtcctctcaccaaggatgagaagtatcccatcctatgctctccctcagctctaagggatttactcaaaaagagaaagagcaattaggccctggacatgcattctaacttaattttagcctcagtcttctctgatggaaaccatgctttaaacatttcactccccactaaactcagttcatatcacaaatcctcttcaaaataacagatttatttaaccttaagtaaaattaaccttggattgatccgaggtgaataaagcattttagttataaatggaaagcattgagtctgccatttctagacccatttctaagatgcctaggatgcattagataatttatataaagtgatgttgtgtaactaataaacacatattctactgatgaagtgtgtgtgtgtgtgtgtgtgtgtgtgtgtatgtgtgtgtttgaaagtttggcagttacacatacagtcatatgccacctgccacctccgtattgtgctgtaagacttcttcagtcatccttaaggaagtgtttgatccctctttcttgttacatataaagacaatgcactttaaatactactttaaaatctgcatcagcgttatatgcctgcttggccctaggctccagcttcaccacatgattttctctccaaatgaaatatacacactaccttgggttcttctgtgatttttcctgtctactcacatttctttatttttcactcttggaatatctgaattcatcatgcataatttctgctgtttcatgtacttgaggaatgcaaatatttgagatctgcagctacagacaaatcaatagccttgtggttccatttgttcccttctagcttttaattctgatttttgacagtttctgaatatggtaagttatagccctgcattactaagagcaataaaatataaatatatcaattcctaatgaatttaaataacttgtgaaataaatcaaggagcccggaaaatttaaatgataaaatttaaggatgagattcatgtgctatttgctgactaatgtaaaaaaaaaattcaacctgtttatgactaatgttaaatcttaaaatttaaattgcacatgaccttggtctgttttgtttcactatgattatgactaatccctcccaaatttataacagttgaactaatgcaatgttgactgtcaacagttgaattcctaaaacaaaaataaatatgactcgtttcatttaagatgtagatgggattccatggaaaaggacaaagatggatgattatgctgtaatagaattggttggttgccagcgataagcttcaatataagagtggcaggtgcattgtagtggaatgaacaatgagcctagtgtcaaaatctctaacagtatgacctcggtggagcctgtttttgttatcgagggtacatttttaatagatgagcccctctggggtcttgagtaaagtgaagaatcataaacacattcactattagaatctgagggactctgtcatgtcgtcttccataccgctggagctgggtctgcctagttcccgaaatggacactccaaaaatatcttataggaaaaataaagaaaattctttcttcctgtgaaacctttcagccctctccaattattgtcaaatacagtgattttattcaggaggattcagtctgctattttaacctctggctttaatgctaagtattctagcctaatatttatactatgtatattttctcaacgtcatctaccagtcagtagggtaccttggtattcattttcttctgaatttatttactaattcaacaaatacttattgaattgtttatgtggcaggagcagtgctaagttctgagaacccaaaagtaaaaaaggacaaaaaaaacccctattttagggagctttaaaaattacatggatacatgtaaaattactatagtaagtgctgtgaagaagagatcctggtgcagtctatgcatataatggtagcttttactgatcatggaggtgagaccaggctttcctgaggaagtaattgttcaccagtatctaaaggatgagcatgagtaactcggtaaaaggttgggcatgagcatttcaggtgaagaatatgacacgtgaagcagtcgtgtgtttgagaggggtgtggtaaatgtaaagtcagtgtggccgcagctcagagaggaagaggaaggctggagaagtagtggtgctactaatgtttaaactcgtcccaaaggcaatgagaaaccatcaacgtttattaggcagggttgagagtgggtgaagtgacatgatctcttttgtatctgacaaaccatccttccttgcatgcggagactggctgccttggtggatgcaggtggacaaggcagccagtggagtggttgagagaagagatattcacggctaagatgatggtggtggtggaggaaagcaggtgacacgagtttttattggaggataaatttgcttaattgttaatttaatttatttttattgataaatagtatttgtacatgtttatggggaatatgtcatattttgaccatgcatacaaattgtaatgatcaaatcagcatattcaggaaattcatcacctcaaacattcatcacttctttgtgttgggaacatttcaactcttttcttctagctgttttcaaatatacaatacattgttgttaactacagtcatcatattgttctatctaacatcagaacttattccttctatatgagtgtatgtattttttttttttagatttgggggatatatacatatatttgtttgttaaatgggtatatttggtgatgctgggatttggacttctagtgaacccatcttctaaacagtgaacgtagtacccagtaggtagttcttcaaccctttactccctccctcctttcctcccctcttttggagtccccattgtctattgttttcacctttatgtccatgtgtacccattgtttagctcccatttatacatgagaaaatgtggtatttgattttctgttgatgcataaattcacataggacactggcctcctgctgcatccatgttgctgcaaatgaaatgactttattctttatggctgcatagtattccatggtctatatgtaccacagtttctttatccattccactgttgatggatacttaggttgattctatgactttgctattgtgaatagtgctacaataaacataaaaatgcaggtgtctttttgataaaacatttttttttttcttttgggtagatactcagtagtaggattgctgggtcaaatggtagttctattcttagttctttgagaaattgaatttgagaatacatttagcagggcttggagagtgggagtttaggaagctgatggtgaggatcagggcagatgactgccagtattgcttggaatatgtaaatcaaccattggagaggagggcaacatgtataacattataggagcttttgactggtttctctgcttagtagggaagaaaattcagaaagaacaagtgtagctccccgattctgactaaattcacccataagaaagcccctaaagttttctgacccttcactttgctgatgtattttatgcatatgaaatgatacaggtgaaaactctttgagatggatcataatgtataaatataggttattataacatattataaataattgtattacattttatatattaagtatacatatgtatataaggcatatgtgctattgcacttttttattgtatacattgtattgtttttttccttcaagaagttcatagaatgacaatattattttgtattaagaaaaaatctggaccaggtgtagtggcttgctcctgtaatcccagcacttcaggaggccaagacaggcgaattgcttgagctcaggagcttgagatgaacctgggcaacatggcaaaaccttgtctctacaaaaactgcaaaaaaattagctgggtctggttgcatgtgcttgtagtcccaactactggagaggctgaggtgagaggatcacttgagtccaggaggtggaggctgcaatgagctatggtcttgctactgcactcaagcctgggcaacagagtggagattctgtcaaaaaaagaaagaaagaaagagagagggagagaaagagagagataatgacagagagagagcaggaaggaaggaaagaagggagggagggagggaggaaggaagagatggagggagggagggaaggaagggagagagggaggaaggaaggaaggaaggaaggtgtggaatctaatcctcagatctatttcttaactatctaaaagtagtgtgttaatggtgtgatgcttatttattaaaactgaatgaatggatggtaattttgttaacatttagcttttaaaatctagtgaatatatgagctcattttactatataacacatttaacatttataattttattaaattgcaaacagactcgtaagtagacttttcttctctgtacctttggcaacatatttagaaggcagttaaccatccattgagatggaatataaagagtaagtctgaagtttacatttagattttgacagtcatcattagattatgcaaataattaaaaaaaaaccttacctcttgctagtatctgtgctcagtgtccttccaactccattcctttctttcatgttaacatatcaaagccaatgaggaattctatgctgtgcacagaatgccttgtctacctatggcagcaagggccactctgggatatgatatagtggaaattaaagaaaaatctgcctttactccagttttaggatgttttgaggagaggaatgtagattccatcttctcatacggaggtgttcattggggttgtgggagaggccttctgtagaaagagctgaggtcggctcctcaaggagttggcatagcaggctgcccagaataaactgacacctgatagattggagtgttcagagagatggaggcttccatggttttctgaccctggaagtatattgagatccagtgacatgccgtgggcccaaaggggagcaccccacccaccatggagattgggtttaaaatgatgggtcagcttctagacaaaagacctggcaaaaacttagggatctgcagccaagtgagaggcaagaagagtggctgagtcaaggatgacaagagggctgatgttccctgaggtcagaatggttgacaaaataagggattggagtgctgttctaagcacttaacacatatttagtacacctaatctcttttcgcacctatgaggtaattactcctaaaacttccattttgcaaatgagaaaactaagtacagaaaggttaagtaactttctcagtatcacacagctaataaatggtaagccaggatttgatgtagaaatctggccagcaggctgtgttgcaaccactatccatgagcacaaaatccacgagccatagcgaagaggccagcatttttaaaaatggccaagtggaccagggctccaatccagccctgttttttttttttattgttgttgttagtttgttttgtttttttgaataatgctttactgaaacaaagtcatactaattcatttttgtattgccagtggctgctatcctgttacaatatcagagttgagtagttgtaactgacaccctgcgggaggcaagacctcaaatattcagtatctagcccttgcagaaaaagtttgttgactcttgacgtgggcaaaaattatcaaaaccaccaacgagaagcactcaatgagagacaagggaattccccaattccaagggatgcaaaaaaccatcaatgtattttagatgactttttatctgtagaagcagaagagatcattttatccatgggcaaccccattatacctgaaaagacatttaactactggctcggcctaaagtgtaaactgtaaaccagattggatatttaatcaaggggctcagaaaaaaatgacaggagtacacgtgtacacgcacacacacacacaccatgtgtttgtgtatatacacacacaaagaatgtcaactatatatacaaataaagaagtgtaaacacattgttagtttggggattaatatttgttatgagttagtatttgtcttatgttaataaagaaatatttatttgagatacctgctgaaatattgatgggtgaaattgatatgctgtcctgaatttgtcttattatagcaaataaaatataaaatatgtttgaggagtatggtgcaaaagaatagctaaattaatgatcattgttgaagctaaagtgattaatagatgatggtttcttataccattccttttacttttgtgtgtttgaaaatacccataatcaaaagttttaaaaattgcaatgtaaattatttagacagttttcatattttaccatgaagtgaatacagaaaaattaagtgatttcattacactcttgccataatgttcatcccttattttctttgtactatcgggaaagaactagtgaattggttcgaggcatagctaagaaaagaagatgagacacctattggggagttaaaaattacttaacaaatttgttttgccctgtttgccgtcaccacaaacatgaactgaagtgcgaggagtggcaaatggtagggaaatttatatctacagaaaatcacaagctaataaagagttccctaatggattctcttagattcccagtaggtagattatgaaatggttgaatttcacatcaaacccattggaagggtggcagatactctctgagttaaaaacacacacacacacaaaaacacctttcagcctggtgcagtggtgtccacttgtactcctatagtcccagctactcaggaggctgaagtggaaagattgcttgaccccaggagctcaaattcagcctgggcaacctaccaagacccccatctttaaatttaaaaagaagaagaagaagaaaaaaagaaaacaacttttaaagataatgttcctgtccttaaaatgaggagattaaatgtgcattaaaatatctcttgcagcaagtaatttggatatatttcatcaatatgtaatatttgtgctgtgttttaacagtggcgtgtgacatctgttgaaataaaagttttgttatgtcagtcaagctgacagtaaaaagactgcagaacagttttctgacatgctgccctaccaatttagccctggcactataatttccattttgatttccaatttgatccaatgattatgcattcctgcattcttaattttcaagtgtttatgatttctcgatgtattaaaatatttatgtctctatttgaagaactaaaattttctatgaataaatagccatttattcttttaacaaatactgtcttgtgccaggcactgttgcaggcacgacagcaataggaaggaacaagacagaatcctactcttttaaatgaaattgctgctatagtattcactacaatatagggtagatgaatttatctacatcctagtatggtttctgtttactgatactaatctattctgaaagaagcaaattaaaatctcccactacaattatttttatcacattttctttgcattttttgatttatacattcagtttccatttttatttatatgtatatgtatacacatatattcctatatatatatatatatatatgtaaatagttgcctttatttttaataaagaagcactttaccctgattgtacttttaagcttaaattccaccttgtctgaccctgatattgctaattatgttactgttactaacttttgttttggcctgctgtattgttgcccaggcctttatttaagctattgatcatcacatcacttttttgtgtatttctttttggaaataacaaatggcttggttctgtttaacaatcttagttaatagactaccttttgatatgaaaattgactccatttagagaaaaggtggcaatatgtgtaatttttctctttctgtttattttatgttatactttttactgtatgttttcttttgccctttcctattttttttttcaacttggtcaaaatactatttttattttcctacttgattgtttagcagttctgtttttgactccattaaaggttaccatctgcagcagaaaaagttaatgtagtactttacatgaaatttttgctgaaacctgtatttattttactagcattacttatgtaagaaaggaagaagttattgcaaaaaaaatctatatcatacccacagttgcatatagcaatttatattaaagttaattacaatttaaacgtccattcctagccacaatttatcagtaatcatacgtgtttgttggctaccatattgttaatagtgcagatttagagaacattttgatagtcacataaaattctgctgaacaataatagtatactttgtataaactatatataccatgtatatactttgtatactataatgcatacattttgtaagtttgggaggtaattgttagtaggttaaatattaatgattaataaaaagttcaatttcctaatacaaacatgaaagggcaatacaatttcacatcacagaccttttaaaataacatcagagtttaagtgaggattatttaacaataaattatttaagttaatgaaggatatcccaagagaacttcttgcaaacaaactagccaggactcaatttcacgatgacaagatttcgagtaactttaaatgtgacaagaaaggacgtttgccccaatgtgtctaatgcatatacacttaatgtccttaagatattggacttgtaaatagtctgaagcttttgccattatttcaataatgggtcctagtgtctagcttaaggcaatgtattcttaaggcactggtgtcaatggtttttctgttttttaagatgattcattatctgttcaatgaaacatgtggcctccagtatcaaccacaattttatctgaagttggtgacaatttggaaactctacattgtatttcacttttctagcattaataatcaaacacatatctctctactattagatggaaatatctctattttcttcaccaaatactttcaaggctgtttctcccactcaagtaagataaactttaaaataggcttgatgttcactccatcttccacctcaaagcctgggttttattaaaatagttcagtagttctatagtccagaatactttaagattatcctgtcattacacctcttaatttgaaaaatctcatatatttccagatagcctatgcttattcatttacatactactgtgcgtgtataaacacacacacacacacacacacggaaggacacacaacctaccactcttcccccttatcctctccaattcatctgaggactctattatgatttgagtggggaggtgttcttatatcattccttgaatattgtcatctgatgtggtcagtgactgataaaaatgtttaaagtcatagtctttgtaattacaaaattagaaaaacacttaaacactgttaattagaagatgagtataaatgcgctgggtaaatgtgctgggcacggtggctcacacctgtaatcccagcactttgggaggccgaggtgggtggatcatgaggtcaggagttcaagaccagcatggccaagatggtgaaaccctgtctgtactaaaaatacaaaaattagccgggcgtggtggcgagggcctgtaatcccagctactcgggaggctgaggcagagaattgcttgaacccgggaggcagaggttgcagtgagccaagatcacaccactgcacaccagcctgggggacagagcaagaccctgtctcaaaaaataaataaataaataaataaaaaagaagatgagtataaaggaacttggttccttccttatggatgtttagcttgtttaaaatgttgctatcacaagcaatgtaacatgaatgacattgtcatttcctgtgtaggccagtatgcctaggatacaatcccagaagtagaattggggtataagagtgtgggtttgtatatttttattagatagtgccaaattgttttacaagggtttctacaatcaacatttccactagaaatatatggaaatccctgtcttcctgcaacaattttggaggtttggatttttagagccaatctgataggtaaaaaattgtatcgctgtgcaatttaaacttattttttcttattttgaatgtgactggaatcttttcatatgtctaagagtcatttgcaattgctgtttcataactttctatttcttagcccatatattttctctgaccattgtctttttcttgttttccgggagcacttgacctattagaaacataaactctttgcagagtaatttatagataaaaattatttttccagtttatcatttgtcttttgattttacttgcagggttctttttccactgagcattttgaaatatttttgtagttgaatttatttcttctttatttttcctttctctctttctttcttttagagtttctggattttgagacattgtactgtattggtcaggataggtgaggttatgctattcctagctcatgtggttgttggcagaattcaattccttgcagctataggactgacatccctgttttcttgttagttgtcagcctggggctaatatgaattcccagaggaccatgaaattccctaccatctttcttttgattaccttaaaaccaactgatcagtgactttaattacatctgggaaattcttttactttagccatataatgtaatccaatcatgggttgacattccatcatattaacaggttccctctatactcaaggggagggattataccaagaatcttgggagctatcttaaaatattgactatcacagatcttcttgaaatttctcatcttctggtttgcatgtttattaagtcatcagattcctctttttttttttttttttttttttttttttgagacagagtctccctctgtcgcccaggctggagtgcagtggtgcgatctcagctcactgcaagctccgcctcctgggttcacgccattctcctgcctcagcctcccgagtagctgggactacaggcgcccaccaccacgctcggctaatttttttgtatttttagtagagatggggtttcaccgtgctagccaggatggtctcaatctcctgaccttgtgatccacctaccttggcctcccaaagtgctgggattacaggcttgagctaccgcgcccggcccaagtcatcagattcttaaagcaggtttataatgtattttaatatctgataggaccagctctcttgttgcaattcactggcttatatttatttgataaaatttccatatgggttttagaataaacttaccttgttcaaaaacccctttagagaattttataagcatcatgataagatatacatgttaacttatggaggagtggcatgtaagtgatggagaggtttccttttcaataaaatattgaatttccatttactcagactcctttggtttcaattaatagctttttaatttttttcttattatggttcttatgttttatttgttttgagatattttatctttttgttttgattacatgtggaatattttactaatatatcctataggtattattattttcttaaaagcaagctactgaattcagcatattcattatatacagtaatttttcagttcattctcttggattttctacttatacaattctaactgctgtaaatagtgacaattgttcctcctccttaatttttttgtacatccaatttctttcattttctaactgactgctactaaaatataattttaaagaatactggtgactggggatattgttttcttcttctcaccctagtgggaatacctgcaaggtttgacattaaccatgaagctattctaggctgagagagatatatttatctgggaaaagctagtatccatctgttactgttttattgattttttaaaaataaataattattgttgaactatgccaaatgtattttaaagcatcagttgagatgattacctaatattccttcttgaacttattaatatgactttatataaatagatctttgattattgaactatgcttggattatttgtattaacacttgatcatgatgtattattctttttacatgctgctgcattcagtttgctgatactttatatggggctttcacattacaattattaggtaatattggtgtataatagatcttgatcaggtactggaacgactattaataaaatatttttaaactaattcaaaaagtgttcttttatagtctaacactgtttgaataatatgataatctactttaaaagtctggcagaattcggccgagtgcggtggctcacgcctgtaattccagcactttgggaggccgaggcgggcggatcacgaggtcaggagatccagaccatcctggctaatacggtgaaacccgtctctactaaaaatacaaaaaaaattagccaggcgtggtggtggtcgtctgtagtcccagctaatcgggaggctgaggcaggagaatggcgtgaacccaagaggcagagctttcagtgagccgagatcgcgccactgcactccagcctgggcgacagagtgagactccgtcttaaaaaaaaaaaaaaaaaaaaaaaaaaaaaaaaagtctggcagaattcttccatggacacattccatcctattgctttttttgatgggacagggaagggttctttgacaacttcatatattttgtctgtttagattttgaatcttcccttagtgagttttggtaaattgtgtttttctagactattattcacttcatcaagctgtagctctatgaagttttgatatccagtaccagtctttaaaatacttgattttaatttgcaatttcctctgacataaagttacaaacttaattttttaaattcctagttgtcttctcggttagtcattaatttcttattttatcactttttttgaagaatactctgtgcattttcatatgttttgggtgctattgtcaatttttgttaatatccgataggcacataaaaattgtactctctattaaagggcaaatgttttatacacacacatatatacataatgataaacatataggtgtggtatgtgacatatctatatatgtcaatatgatctatcttattatttattcttttccatatttttaagtccttttattcacctgtgtaattatctgtgagagataagttaaaatcgctcattaaggaagaggagaaaattaacttggttctttcctgttcaaactcatgtttacttttatgattaagagacagaatttgacatgaagtcactggttcatatttttttcattgtgtatatcgtaggttgttacattatgtggagaaatccaagattagtatgatattttcctttttaaaaattcggaaagatatattttgggcaatgaggccaaaattatcaagtcatttaaaaattccaagactttaccaggatgtttcacagtgttgactatttgaaccagtttcctcaagcactaaaacattttcaattttgagtcatcttccttatttttcaacattttcttattaaaatatctgtaatatttattaggttggtgcaaaagtaattgcaggttttgccatgggccatttttccctccaatttcatcttttttttttcctgtcatttaaaaaaatcttctattttaattattttccctgaattttgccagctaatatttagatggcatctctggatggtttcactatttttttcacatttttttttacatttatgctgtgtaggtttttttctttataaatgttattacttcgttaatttattatgaattcttagctaaacatttggatacttttgctttatatcagtatttctcacttgtgagtgatctacatcaaatgataaattccaatgctatttttgatattttttcttaaaatattataaattctacttagtttgagggctacttcctcaaaatctcatctcttattccaaacaagaagtatagtttttgaactccgagttggccccttatcttcaagaaggcattgatttattgattgattgactgattgagacagagtctccctctgtcgcccaggctgaatttgggatgacaggcacacaccaccatgcctggctaagtattgtatttttagttaagaggcagggttccaccatgttggccaggctgatctcaaactcttcacctcaagtgctctgcctgccttgacctctcaaagtgctgggattacaggcatgagccaccatgcccagccagaaggccatttttgatggggctctctgagatttttctgcttctgggctctcttgtaatatcccgtatggcttctacttgattcagctatttttggaagcccttactgatatttttgaatatgcagattggaattgtcacctaatgtccctgaaaatggattttgtgtatattaacattgtttgtgctgcatctttatgattaccagaaaaattatagggaaaaactagacatatgcagccatgtttataccaatattcctcctgttttttagttcaagtattaatatgtaactctcagaagctgtattttattaggatctttcctgaatgttccacttgctctgattttctctggctgcagggcttctcacatgtgctaggattttcttttctcagctctctgggactcaggctgagctccaccgtaccttaagctagagccgtgcggtgggtggcaggaagtgctgtggtttcctccacctgatatagtgaaagcagcgtgggttctctactaaggagccaggagaagcctctgttttccttctcttccagaggtttcagcctaaggtataaacaagacttatcactggtttatctctccctcaactgtttggaagctactgaaatcaggtatactcatatggaatgataccatcatttttcttcttgggatccatactttaatgcaagacaggtcttgccaatatccactactattgccctccccttggaattctccatcattaattcctaagatcccgtcaagctctgaatagagaagctttcgggactgaaggagagcacagatgtatttaagccacgatcgcccattctccctcctaattttgcctatgaatgggttttatacaaattgttatgagattgaagaactagtgaaaaattaattggtactagtttttaacacacttctctatacttataaacttccaggggtgaaatttgaaaggaaaatatttgttctgccacttgtagtatttcaaagtcttgcagtattttgaagtctcctagttacattgagggtgattatacttcattttacaaattgctttgcattacaaaaaaaaaaaaataggtttacagtctcttaagaagcccttcactgattggctaatggtttctgatggtctgtagggtctaaatttgagcatctgggagaataccactttctctatccaagctgcctagctgcagggaaaagagggtagacagtagcctgacttccagggaaatcatctgtattgcaggttagggccaaagtaggtcagtaagagtagggaggctaaaaaattgactgaaacaaagaggtgagtagcaagcaattattaggagcaaaaacaaagtcctggaatcacagtgtcggggaggtaaggatccagggtgaaggtgtgagcaggtaaattggaaggtgttctaagccaacatgtaaactcagcatctgccaatgcaatttctcccaatactgtccttccttgaatgtttgttagcttattattttaatggcaacatcagcttcaacctctccttgtctcttaacccacttaaacaatatgtggccattctatctccaaattatttccccaaccacactccccttcctacttttgctgtaacttccttttccatcctccattatgtctcctggaaaattgccgtcattcccttaactggtttcttcagaagcctccagtctctccctcccatccatccttctcaatgctgtcagagtaatcttttcatgtaagagtgacctccaattgtaagcgcgacattgctgcaatatcatttatctccatcattattgcagtttgtattttgcgattggaaggatggggcaggcaccaaaaaggtgatgtgacttgtgctgtattttccgagtaagtccaagaggtgaattatggatttttctaccaggctgactcaggttgaatgctgttcatttctgggtttgtgtctattatcctgcaaataacgaatacccctaaaatgttagtgtgcaattatgccattgggatagaataattctctacaacataaaacagtttttatacaactatgaaagtagtctggagatttcaactttcattcaaacaaaattgaaagaaaatgaataacgttgagacaactgagcacaaaagaataatatcgtattttccaaaatatacacatcaaccactttaggctattgtatgtgaaagggccgtaagggtagctgggtagaatatgcccaaaatttcttccaatcatttttttttcattgcgaaataccgtaagaactctatccagggagggcgactacatttttggcagggacaagatacaaaaactagagagatagttgttcattctttgagcagcaataaaaaattcagtcttgctctctctcttcccctctcttccctctctcctctctccctcattctactcccttagaatacttgtaagatgtcatatgtaggtaaaaggaatacatcatcagacaagtatgagcactggaaattagccaatgtagccaaacttggggaaatttatgtgttgcttactctaagattgaggcaaatgagagtgacagttctttccagctcctcccctgattactgatgaggtattactctctgagttgctctaagattgagccaaatgagagtgacagttctttccggctcctcccctggttactgatgaggtattactctctgagttgctctaagattgagccaaatgagagtgacagttctttctggctcctccgctggttactgataaggtattactctctgagttgcctagtagtaaagaggaagtgcggtcatctagcatcattcaggaggtgaatttataatggttcctcattgtttaaagcaatcttttatttctattaaatgtctatacttttatctaaaataatcatctttaaataactgagatcatacaacattccctaagtgctcctgtgtagcacaatgttatgacctcttctcttgtcttcttctcttctccacctgtatagagatagtgacaaatcaagtcaatatctgtgaaacaaatgttctcatgattggtaaagcactcactggctgtgctgaaatctgggtatatttatttttcattatagctaaataaaataaaaaaccgaatagcaacaacaacaacaacaaactcacaaaaatctggaagataggaatgttcagtgtggcaggtaggatcaggaaagcagatgagtaagtgtgctcttgctgaccgatatttaccaagcactttccaggagccagatagtaggtacactccctgcattaactcatttaatactcacaccaaatctatgaaggagggtttactattgccaccactcccccagtttcttatagacaaagaaactgaggcatagagaggttaatcattttgcccacaatcattcaagtagtaaatggtagacctgacgttcatttcctgtgatcttgatcctctccataagatgaactcagtcttatagatgctttttcaaccacctcatcgtgattacagaacattctggctctattactttgaacaaattattcaacctctctgccaactcgggacaataagacatatatgacacatgatcttcaaatgtgtgaagattcagtgatgtaacaggtataaagtgttcagcacagaagcctggtgcaggccaggcactcactaaatattggttgtcttttagagtgattttcttctacctgaatactcctaagcaagggtattttcttctttattttatatcagtgatagttaacagagggcatctcacacaggaaacgatcaaaagaaaggaagaattagagggaaggcttgatttacataagtgttggaagctggcgtttctgaagaggccattgaaggcatactgtcatatctgagtctataatgaagaccagaattttagcaaataacttgagaaagtgtccaagcaagcagcaaaacttatccctagaaaaactcatatataaaaaggttggcagaaaatctgaaatgccatcaagcaggagataaagatttggtacatttccatggtccattttcaatctttttacctgtatcttctacctcaccagctcctagctcctgccgtgaaagtttgggcctgaaaggcaagaatgcaatgtgattgtattcacaccaaattgtaaatgttgggcttctgttctttccttagatttgttttgattttgtacttggattagggggtattgcaagatggcacctagtgtatgaaagctattaattgccaagtaggggcaaaagatcaaaaacgaaaaagaaaaattgtagtaaaaaatctctttagcaagagagcttagataaattacaactcccttagagctttcttttttttttctatttgtacagcattagtaatttttgctcaatcaaaagactatgctgaataaatggtgttcatgaaaatggattgataattgaaaatggattgataattaattgttggctgtcaacggtggctcatgcctgtaattccagcactttgggaggtcaaggcagacggatcgcttgagctcagtagtttaagaccagcctggccaacatggtgaaaccccttctctaccaaaaatactaaaaattagcaggatgtggtggtgcacacctgtagtcccagttacttgggaggctgaggtgggacgattccttgagctatagaggcagaggttgcagtgaaccgaggttgcgccactgcactctacctgacagagcgagaccctgtctcaaaaaaacaaaaaaattagctgggcatggtggtgtgtgctggtaatcccagctacctaggaggctgaggcaagagaatcgcttgaacccaggaggcagaggttgcagggagccgagatagtgtcactgcactccagcctcggtgacagagcaggactccatctcaaaaaaataaataaatacaaataaaaaataaataaataaaataaaaataaataaatggaattgttgcgattatcattatgattattatgtcatcttttagttgagccaatcctgaatgtatttaatgtattagtcctatgctttaaggcagggcttggcttgtgctgcctggacaccaaaggtctcagatgccatctcctgaaatgaccctacccaggacaccaggaaacagctgcatggccagtcctgacctctcaaaaagcaaccgtagcccataaatagcctgatgatggatgtgggaatgagctgggacctcattcccaggtcagattctatgtgaatatgggttctggtttccaactatgtcagggccagcagatatgagtttgtgtactacaagtcaacatttgggaggcctttgtagagctgactccacatccattttatcctctctggcgattgaaggcttgggggaaaacagaagaatggctaaatgagcagtgctaagtcttgtatgagtaagatggaacagttcaagaaagacaattctatgtgcttgagcatcatctctttgattctgacccattttttccactctcctgttttaacctgtcttctattaaaaaagaagtgaattaaactgttttgaaatatgagctctgctacttactaaccagctatatagccttgggcaagttacttgacttctcatttagttcatgggtaaagtagaggaggatcataatagaacctactcaggcttctaaggagaaacaagataacctagcaaagtcctcagcacagattaaataataaatattacctcttgtgaatttttcatttgtaaggaagcattttatcccctattttctctcattagcttgacaacagaactttaatccacatgagttgatgccctataatagaggagttgtgggttgatgttattttaaaattctaaccacatttcctcatcttttgatgacacttcaaacttttcattcattagcttggtattgtcaaggcttctaaaattgccagatgtcaggttttaatttgcagggaccccggagatcatctcatccaaccctctcagttttatagtgggaaattaatttaaaatttaaaaaaaaaatgactgacccatttgtttccagcattctgtaactgcattaaaaaataaataaataggccaggcacagtggctcacgtctgtaatcccagcactttgggaggccgaggcaggtggatcacgaggtcaggagatcgagaccatcctggctagcatggtgaaaccccgtctctactaaaaatatttaaaaaattagccgggcatggtggcgggcgcctgtaatctcagctactccagaggctgaggcaggagaatggcgtgaactggggaggcagagctttcagtgagctgagatctcgccactgcactccagcctgggtgacagagcgagagtccgtctcaaaacaaataaacaaaaaaacaataaatagcaataaaagagttcacgggaggtaagctgccccaggttctgtcccaggtcctttggttctgtccaaaatttatgccattggttatgtcactcttaactctctaggacctcattttttacactataaactgataaatttgacaatctctagctgaatgtatatgtgtgtgtctatttacctgtatatttacctgaattatggtaataaatatagatacagatttttgttataccacccattatcagcataatgcaatttccatactgtatttatggtccatggttaaaatgatgtgtatacacatgtgatgttttaatatattagagctcatttcaaagaaaggcagtgcaaggtctgttattagcaatgtgtggggtcttttaaagtcaacacctggtgaaaatcctcactgcccggagtacttttgaaactccttttctgagccctttgtggagcctgaggcacactgttctcatgctgcttattgaacagcagagctgatctttgcctttcaggaacgatttcagttttcaaaatagcctaaagtaaaataagcatagcaatcaatatgggcaaaactacatttagtcaaaggccagctgtgtctagcagataaaacgacatgatcttcttgtgtagatcttacactgaagctggcaggaaattagaaggcagtggctgctcctgtgtgaatagtgcctccaaaggtgccgtctttgaaggatgacattactttgggaacatgggtgcattctgctaaaactgtatgattattatcttatgatcgtatctctgtgtcaaagacaacagaatcatatacgtttgttgttttttttttttttttgagacggagtctcactctgtcgccgaggctggagtgcagtggcaccgtgtcggctcgctgcaacctccgtctcctgggttcaagcaattctcctgcctcagcctcccaagtaactgggattacaggtgtccaccaccacacccggctagtttttatatttttagtagagacagggtttcaccatgtggccaggctggtcttgaacttctgaccttagcctcccaaagtactgggattacaggtgggagccactgcgcccggcccatatatgtgatttttaccatttgtccatagtcgcaataggaaggatgagggagatttttggcctagcataattattctaaggaaattcagttctgaccacaagcaatggtgttgttagtgtgagaacctggtgctgtgactggggcattccctcagagacttctacttgtgccttctctctcctatgtaggagatctcaacccccgcgaaaagagtgcattgcatttttactttgaagaagtttgagaaagaattacttacaacattattattaagaacttagaagaatattcaaaacactcctataactaacgtaagattatagcaatcaatgtgctggaatacaaggacactctggtgttgggaacgactgcattaacaatcataaattaagtatacaatttgttttgtcccccagtgaattctatgaggagatatactttaaagccagtcctgttgaaaaccctgatgtcttatgaaaaaaagtagaaaattgaaagaacactgacctggatttcaaattcagtagctgctgcttttatttgaacaaatatttttgcctacggacccttttttccccctcctggtaaaatgaaggggtgggaccagaaaccttctttaagtgacagtccactgtggcccgcattacacataaggccttgctcctggccgcacttctgtcatttgctccattttgtctgacagaaacgggctaagatttcatttcataaaacaaaacaaaaagtgtttctacttctaaaaaggaaaaagttgaaaatctcttcccaagttcccttatgtccttgttttcctgtagagaaggtggtgctttcatctttcctaggccgagctgtaggttcaattttctataatttcagaaaagcagagctgggtttacctatggagcaagagaatcttggcaggaggaaaccatggagcagattccaggcttcttactcagcactgggaggcgaagaacttgtcacccttgagaccctctcctcttcagtctagctcatgtgttcagcgtgcaggtcatttgtgccaattagcttacctttccaatcagctggttgtgacctgtcattgttgccagctcccaaaattggaaggttttcttcctaaaatatcagtcctatgctttccagaaaggtatagaatgtgcagtgtcttcacagcctgtagaatgtgtaatccctcaagtgagattacagaagacagagatttcaaattcaatatgtctaaggtagaatagatttttttttttttttgctgtaacaggcatgaatttcgtgtttcaatgatacaacagtaatctagtttgccaagctaaagatttggacactattttattttcctcatctaaatgtcagatccaggaagaaaatgaatttttttctctttagtcctgtcctcaatacctagaaaggtatttggcacattactggaatgacatatttggtgagttaatgaataaattaatattcttctctttaggtcatattctacatccagtcttcaagaattgtctatgtagtttcaggtcttgtttgcaaacccttctatcctttcagtctgtgctgctgctcactgattgttctctttcttacctcttccttggattatcacaattttctcctaagtcacctactttcagctgcttctggccaataggctctccatactgcttcaagagtgctggatgaaacatagcatatgatcatgtttgtggcatcacaggtggtttatgttcttagagctgtcgatcaagaaaaataatgagacaagtctcaatcattttaggaagaggtttatttgccaaagttaaggacggatcctgggagatgggtctgtgcctttctctgaagatgattttgagggctccaaatttaaagaggaaagggcaggatattgagaagtagacaatttcatgtaagaggaaggcagggaaaaaatagtcatctgtgcctttgtctggctcagtgaatctacatttttttttttttacataagatgatatagacaaatgaggcagagtaaaaattcagggaatctgcattttacataagataacatagacaaaatggggcaggggaacaacgagatatgcctttgtgtctggtgggcagggggtgatagtacctgtaaagataagctatcaatttacattgctatggcaaaaatttaacagaaacaccttaaatgatcttgcagctcactaggaatttcctcatgggcaaaatttgggtggggtgggggcataggggggcatgtagctttcatcttgtagccatcttatttaggaaccaaaggtggaggcaggtttgtgtgacccagttcccagcttgacccttcccattggcttaatgagtttggggtcccaagatttaatttcctttcacagagtatattttccacattccctgtgatgtatgtatgtaaacaccatacacagaggaaagaaaagaggtttaagattaccgtgtttcactcctctatgaaattcttagtcacatcccgtgatccttaatttataatccaaactcaacagggcatgcaagtttcttcaggacccttctcgtttgcatctgacaacttttgagtctatattctggccatagtgactgtctcgtggccctcctcatgcatgacttgtggtccacacaactttcatccctttgcaaatgctgctctctggacacagagtctttcagacagatccactgctctttgaagactcagctcatatgtcaccactcttctcactgttgcctctgctcagcccccacggcacagaacatgctgtattgtagcaaaatcaggcctctttacctcacaaatagaaagtgaacatcttgaaagcaagggcaatatctagtttgtctttcaactcctgctttcagttgagtggcagctcaataaatatttgccgaatgagtgaaaaattcacccagcaaccacattatgcctcttgggaaaagtaactcctaaagagtgtctttataaataataaataccaggcttttccttgtgcagaaaaaacagacctcccaaacatgtttattttggtctaatacacagaagtgtatattggtgtgagaacaaaaacccaccaaatattgttataggaaacatatcttactgcaacccagctgcatgctctgtgactttaaaatacatgtttaaaatgctttgcaaaattgcagcatctgaaagagaagtacaggatagtggtgcacacagagctggccctgcagagctggctgctgtggggagtccccttggttacatcttcccatctgtacagacagcagcaggtggaacctgagctgttccatatgcggattagtcaatcgctttttctaaaggttccaagaggcaagcttacattttgtcttcagatctttatatgaaaataccactgtggataatgaggctgttgtatgcataatttaactttcggaagcctaaattccgccgaaaggcaaattggtacctagaggcatgcaatttgcatggggatttcaagccctcctcctatctattgtccctggcatggtgttgcttttcttctaaattattttcccttgttctttgaatgcctaattctgagattgtaaccagattaccatgggctccatatttaatagtggtttcagaaacctgctgagcctgctttgaccatttctgggagcataagttggggtttggcaaacctctgccagcacccagaggcagtctttctaatgaatctgctccttagcctgcagcccacctgcctggagagggttaggaccagctgagcctgcagctgcccagagtgggaggagctgatggagtcctgtgtggctgacttcacagctcaatctgtcaatccggttggggacagatggttagagaactgtctgtctgaattgcctcagaaagaatttggtttcttggctgcatcttcaagtcatggtccactttcctttctgctctggactggagaatgtggctgtgttgggaagggtactaactctacttttcaaagcctttcagagtaaggatgtgtgtaagtaaatcaagggctcaggagaactaactgctgattgtcttctgatatttcgtgtgtcatctaataggcaatgtcgattttgcatgcagtgcacaggagcatacctgtcaataaattctaactgctcagaaatgatttcttctgagtagcatgtttgtattttatgaaggtaagccatgaagacccaaagatgtgccaatatgtttactgtaaccatattggataattttgacatatggtgaccagggcagtttacagatgactgagaagttctttcctgatgcttagtaaatacctaagtcatttgaaatgccaactagaaaccaaagaggaaaagagaattggtgtggaagaggagaaaaagaaaagaagaaaagcgagacagagaaaagccattttacctaaaattggaggtctatttcagatcaatttttagatcaagagatctaaatctgggtcagaactcactgaatacttagctgggtgaaattgaccaagtcactccttcattccttaaaatgaaggcattggacttaataatttctggaggtctccttgaaatctaatattcagaaaatattttatttgtcctctaaattaggttattgtagctatttcaaagatgactggggtatgtacactagccagaaacagggtagcaggtctggggtagagacagaggtccaagttccctgtgatatggacaacacataaggaaatactgcgtagaagagagtggttccccagcaaagtccccaaccccaagcctagaaacctgtggccttaaatgggagctggtattcctgttttcacgcccaaatgttgccttttccaagaccaatctggcttaccatatctgctatactttgctcatataaaccccaagctccacgagcagaagagcacgagagctccatcacctttccagctcctcatccattctgctgggagtcacctccatccagcaataaaatcccccgcatttaccatccttcagtttatccatgtcacctgattctttctggatgccagacaaggacccaggtaccaagaggtcactgagctggttaacacttaagctgtctgcagatagcagagctaaaatagcactgtaacatgccccctggggcgtcagtggttgcaggcacccacccctagatgctaccttggggctggagcccaaaagcatttgccctggctcctgcctgtctgtgtgctccccctccagtaaagggtttgagcgcatggtggctgaacaggtaagccacacccctgtcacacatcctgtggcaggggtgggggtgggggtcagggaactctcctgtttcacctgcagccccccaaataattatcattctttgagttcttacaatgtaccaaaacctgcgttgagcaccttaaatacattaccttgattattccttaaaaccacctgcgacgtgattattgtttcccttcttgtatgtctgagaagataatgacttaaactgcctcaaatcccttcatccagaaatgggatgtcctgcattttgaatctctgctttattctacctctataaatgtctaatttgcctaatagtgatcccctggttttgggttttgacaagataggggcccacctaccatttcctcggctattctatagttgtatgttataaggagaccttaaaataaagatatgatttgtcttgctaggagcaaagcatgtatgcatagctcatataagaacacatttctatggagataacattttgaaccaaagtggctttaaaaggcagcagagatgtgtatatttcctgaaggcatagaacctttttctccctctagttaacatggcccttcttttcttaagactgacagttgtattcttgttgggcagtcactagaatttgttctgttgccagacctcctggggcatcaaagtgctgtctgaattagagaataatggcatgatgaggtcaatgacagctctgaaaatgacatgttgccatagtggtaagaaaatttcaaaaatataaagaactccattatcttatgatattttattagtatctattctcctggcatagtacagtttttattcttctaggaatgggttgaataagttgagtccactcttatttttatgatctaatgcatagaggcaacatcaaaatacgaatgccttgcaaaagattgcctatgttgtgaaaatgagaagatgtagttgttaaatgcccataataagtcaggcattgtaataatttataagagtggataaaaatactagaattaaaatttaggggtttttaaaaattcctttttcttcacatctgaagtgtgatattgatctggatgtgtggttgactccaggatggtgaagaatatgtaagtagggattgtgataaataaagttcaaataatatgagattaaaaaaatctttatagaaaaggatcagggagatttgaatacaagagttatattgtttagttagttctagctttccaaagattttcagtagattttattaaaaggattatgttccatattagctttttttttttaaaattttgctttgcagacatttaaagtgatcctgatattcaatggcacatataaccttcattgatttgctttccagctctttgtgactttacaaattcaatgcatacaggtaaagtgtaatcaagttattaatctttgagaatctttatgtactacttataacagaatcagttcttgtgactcagtaaggaaggcaaacattttcatgaattgcagtctgtagaggagaagagtagtgttgattgtatttctttacttttatatcacagagttatattacacccagtcatttacatttgatgctatttgatatgataacatttgctatgtgaacagaattgtagaaatcaaaaatcatttaaaaagagtctcttcctcccagtcctagaataaaacagttccgtctggcgtactgttattcagagccttctgatgaatactatgttactaacgggtaagaataaggagaagaaaaaggaaaaaggagaaaaggtaccatttctgcataattgaaataaaataggaattactgtgggaagtatttcctggatgttccacaagaatttattttactttcagtctctaaattatgacagtgttgcttataacctttaacagttggattccagatgtcctccatttaacactgttcatccaaacatgtgtacacaattggcatatctactttttatcatgctgtgataaacatcatgtatttcaggtactgattcttttttatacatcaaaactgcttcagatcagcagaactcagacacagtgtatgctgggacctcaatagtgtcagccagggtggggcttagtcatggttcaaagaaaaataaattgaaataatcgtatgtttttcttaaaatatgttaatattgcatgtaaaatcttcacatacgtgggataaacctcacttggccatgacatattatcctttttttttttttttggattaagttcactaaaattgtgttaagattttttgcatctatgtttatgaagaacacttgtatgtaatattcttgtagtgtctttggttttggtgttggaggaatgttggcctaataaaataatttgggactgttccctcctcttaaatattctgaaagagttttacagaattggtgtttttttaaattacatttatggtagagttgccgagtaaagtcatctgggattggagttatctctgtgggaagattttcaactacagtttactgatatagatagttcaataattatatataggaaaattccagttatctatttttgaaaaaccttctatggtttgatgttttaagtattatttattatttatttatttatgagacggagtttcactctggttgcccaggctggagtgcaatggtgcgatctcggctcactgcaacctccacctcgcaggttcaagctattctctcgccttagcctcctgagtagcttggattacaggcgcctgtgaccacacccagctaatttttgtattttttgtagagacggggtttcaccatgttggccaggctggtgtctaactcctgacctcaggtgatacacctgcctcggcttcccagggtgctgggattacaggcgtgagccaccgtgcctggccaagtaatttttctgtttcatcaaagtgtttgttggtggtgacataaatttgttccatataatttcttatttttaaaaatacctctacagtctgtagtgctgtcatttctctcatttctgttatcgataatttgtgtctacttttttccctaccctcgtcactcttgatagaatcaattttattaatgttctcaaaggatcaagtttttatttcactagtttttctctattgattttcatttttccattttaaaaaatttctgacttcattattacttttttccttctgcttattttgtgtttcatttgattttccttgtttttcttttttaatatggaaaataagattattaacatgaggtgtttttaaaattctaatataggttaccagtgctataaatttcccaccaaagtcttacttttgctaattcctacaaatattgatatgctctgtttttattttcagtttaatatactttctaattacttttatattattcctttctccattggttaattagaagtatgttagttccaaatattttgacatttccctgatatcatttacttattgatctctaacttaattccactgtgttcagagcacatgcattgtatgagttgaatcattttaaatatattgaaacttgtttaatgaacccgaatatgatctatcctagtaaatgtggcatgcacactagaaaagaatatttatctgctgttgttggatggagtgtactataactgaattttttcaagttggttgacttttgttcaagttttctatatctccactgatttgctatcttcttgactgtcaactaccaagagataagggttaaaatagcagattataatggtggatttgtccatttctcccttgcagttctattgatttttgcttcatatattttgaagttctgtagtaagctgcatagatatttatcattgttatgcatccttggagtgtttacccatccctttatcattatgtagtatcattactcttttgttttctttcttccttttttttttggagacaggttttcacaccgttgcccaggctggagtgcagtggtgagatcatggttcactgcagcctcaatctcctgggctcaagagattctgccatgtcagcctcctgagtagctgagactgcaggcatgtgctactgtgcctggctaatttttttgtttgtttgtttttagtagagacaaggactcgctgtgttgcccaggctggtagtatttctctttattcctcaaattttggtgattataaagtctacttggtctgatgatagtgtaattactccagctttcttttgggtattgtttgtgtggtatatctgttttcatttatgcttttagcctgtttatatattttaaagtgggctttttgtaggcagcatataattgggtcttgctttttgatccaatatgataacgtttcctttttttttgcatttcctttgttgttttcttacctctatttctttgttttattattttcgtggttgctttatcattatttgatagttttagtatatacctctagctttcactgtcaagttgcaagtaatattacatcacttcatgtgtattataagaactctgcatagtacacttcacttctctctcccctcctcatctttatgctactgttatcaaacattgtatatacatatacataaacatatacatatataaataaacctcacaatactttgttactatttttgctataaacagttgattatatttggaatatttaaatgaaaagatactttatatttactcacataattgccatttcccatgctctgtatttctttgggtagatacatatttctggctgttaattttcttctgactgaaggatgtcctttacatttttttgtaatgcaactctgttactgctggattttctcagctgttgtagccctataaatggctttatttcacctctgtttttgaaagatacttttgttgagtaaagcattgtagattaacttttttgtttttgttcttccctttcagtttcttaaagatcagctctattgacatctctgttgcaaatgtttataagaattctactgttatcattacctttgttttctgtataatgcagctttttctgttggtcacttataagatttacaatttatcactggttttcaatttattgctgtaaaaagtttattatgatgtgcctttatatggttttcttcatccttcttatgcttggaatttgtcgagcttctcaactctatgggtttataattttcatgattttttttaattgactattatatttgaaaatagctttttgttctcatcttcttctggaactctacttctacatatgttatatgcctaatatatactttgaagtcgccccatacttcactgatgctcattattgtttttaacttcctatttttgatagtttctattgctatgtacccaagacccctaccatttcttctgcaatgtctaatgtgtcttccatcccatccagtgcatttgttatttcagactatatagttttcatctctcatttgttttccatttctcaagaatcactgtccttctttgccagaaatctaaagtcttagtccatgatactacattttggccaggactggaaatttctcatcacctttaatgtatgtaatctttgccaaatgaattaaattctctctcaattttcttttaaaaaattgtaattacaaattagctatgtcaaaaaaagattgtttaaaaaataaggtgatccagaaagacagcttagtatattctttgaagcatcttaattagtaaaggctagtatcattaaaattaggaagtgatgcttggagtcattttaggcattgatactttattctatgtgatcagttcattggaagaatgaccctgggctgagggaatgcatataggccatgtagtatgagaaacaaacaagaacaagaaccaaggagagtatttgattatttggatcctagaatcttagactctcatctcagaagcaagattaggataagaacaggacatgggactagatgcccagtccatggcctgagcatcagtggtaaaacaggagaaaactacaaggaccaggtggatgctgtcagcttgccactgtactactggacatggtaccagatttttctgtgtgaaaacctggctcagcagtagatggggctgagctttcagtgtggagataactgtgtctacaatcaagagagtctgagaaagacagggattaaaaatattatttcttgctttatctatctatcttattcatttacatgaatgtccttcactattgtaatgatcttaaaaacaatgaaaccccaaagagtttacttcagcggaggcagagatgtgaataaattatggaagcttagggaccctcatatcccccatctcaaaaaaatgatactgcagctatgactgcaaaccaaatgcgattgcctttctttgtgttcacatgatgcctgaaatttactagatatgtttcttctctcatgcagcctaacatatatgacttgtaaaccagcccatgatatgtcttagttaggtaaggctgccataccatagactgagtggcttaaacaacagaaatttctcacagttcctgaagctgaaagtccgagatcaaggtttggcaggtgtggtttctccagtggtctttttccttggcttgtagtcagctgcttctctctgagtcctctcatagcaattctctatccacataccctcccgtgtctcttcctcttaaaaacaccagacctatcatataagggacctcttcttaggatctcattaactttcattacctccttaaaggtcctgtctccaaaaacagtcacattgcggggttagggcttcaacttgtgaattttggcaagggttgtgggggggcacaatttcataacatagtatgaggaataggtgtttacacagaatttgtctcctgaacaaaacttctatatccttatattgcagaagccaacactctggctcagaggtttatggaaagaacatttgctagaaggagaagggccagtatcttcactggtattttggacaagggtcttgtttggatatttgttatgtgtgtgtcttcaaagtgtgagaccttcggccacatccctcagtggctgaagtagcattctggattaaggaatttttaaaattaaattaaagttttaaattaacacatgataatagtacatatttacagggtacataatgatgtttcgatactatgcaatgtgtagtgatcagaccaggataattagcatagccatcataattcatattttttactgattggttggccaacatctctccaattcatgaatctagaggaacgtggtttatggacctctgctcctgtggactctgttcaagtccgtaaatggtttgagcaaggattgctcaatttctgttaacctcaccatagtcagggtttggggacctgtaactgccttggagtgatttcaagatgctgggccatttccagtcatctcttattctcacagaaacctcctggcatgcctggcacatcttcactcaataaaaccatttaaataaatgattgagcaaagaacacctattcaagtgtccatgccagaggggaagatgtaggagcatactagaagttaatgagccaggaatttaaagttttaatgtgtttgtccctgaagtttgcctcatccatgcttatttttagaaagccatagattctgttgctggcactcatttctagtgctttttttattgctgatcagttttaaaaagtaaaagcaagttcatgccaactatatatttcagccattttctgcatcctttgcctgcctccaaagcagaggtatacaggggagtggagaataaagccactggacagccgagggccatgtagtcccagagacagctcttccaggagcatggaagaaaatattaactctttccacttgtactgagatatttttagagtggcttcttttctctttggcttgtgccagggtgctactttattgaggagctgtcaaactttttaaaaaagaattatttctatacaagaagagtttccttgattctatatccattgtgctcttttataaaaatctcacttgttctgggaacttactaattaatagttacattgcaagtttttttttcttttgcctcaattacctaaaataagggtaaatgagtgctaagtttttttgttttgttgtttgtttggtgggtttttccttcttggtttttttttttttttttttaaagaaaaaaaagaattactggaaattacatttcaggggcacatgcctagtttgggacagattgaaataagaagacatccaaaacaggggttatagagcacacaacatgtatttccaagtaaaaaagcaaggctgtttttagatcttttgtcatattgagtcattgtaaagaatgagactaaatttattggccacataggataatctgtcttattccttcaaagaaactgctcaggtacatgacatttctgtctccaaaccaaatgtctaatgtgcttttatcttggcaatgtcacttaaatccccttccaaatcttttcttatatgtcatcatgtaaaatagactcctggaaaccaaaatggctactcaggaaggccacgctctaggcagttcatcacaggaagctggagctctgtgcttctggtcctatgctccctgagctgctatagctatggaccatggctaccacccaagggtttcccccaaaccatacctagcctctgcggtctgcctgaggtaggaatttcttagtgtgcattgattctctttcttccactttcctgatgacatttcattacagcaaagaaaatttttggccataaagattttccatatatggatcttttccaaaatctgtgtctgtagttaggaacaacttaataagaaggctcagtgttggcaccatttttaagaatatttatttccctgggctaatattcttttaaaaatactgcttcttaagggaaatgatacctgtaaaagaaaaattagaagcttctgaataaatttgaagaggaaagtcatgaaaaattataattatataaactttacactattattgctcttttgctatattttccggtcatttttgctatatttacctgatttttatagtcatgattacataatatgtttttctctctatttgtttaacattgtattataatcaggtttataatcaggttaacagatgcttcataaacatcacctttgacaactgcatgaaattccactgtatgactccaaatgtaatttactgaactgttctattaatggaaatttatgcaattttaatatttctattcatatagatatatggcaatacagatatttgaacaacattttttttctgatttaggatgttttctttagacagattccatgtggaaatatgaggtcaaaaattagaaatatttttaaacctttgataaatagcgttttccatactgtttcctacctcgttgtaagtacaagtttgtccacctggcttcctaagttggtcaacataaatttgcaccaacttaacatctgaaatataataatatacactgaggttcttagcataatttgtgtttcttttaaattggcattgctgatgacattaaccagtgtgactggggaatgattctgttgtccactgatccatttaatgtctcagttctggccatctagtggtctagtctgtgttttctactgaacaacatattgagcttttctctgctgcttcctggctttcatatttactgcagagaaatctcattgtctgcaatgattggacttttagaatagaatcttagtcatctgtattctacggcatgaaaactaggcccacactatttactactgacctgaggactcagctctgcctgcatgtagacctggaaaaacaccttctgcctgtgctcagaatacctgctggacctggtcactctctacccatgctcttttcctcaatgctttccttcctttcacctgttgtcttttcatcttctctctttttattcttggtctggcactcgtgcaagtagaagtgatttgatagcttcctcaggcttttcataaaaagggaccatttccatgcaagtgctatttttaccagtctcagaattgtgtaaaaggctttggttctgtgatattttctggaccacactataaaaattccctgatgctatagacccatgggttttactttaactcagtatttcctaaactgtgcttctgtggaatttcagttcaatttcaatgggagccaggaactaaggttcccatggtcaaataaactgcaaactgtgcttcctaaatggtcttcttgaagatttgcagttcatgttatcatatctaatggtttggagacatcagaaggaaaaaaaaattatgttttaacttggtcactccccactgaggaactattttttttctctttttattttttatggctatacctagagtcatttttccttaaaacccatctggaaaaagctggtttgaccatgcaacctgtttattaaagtggaccatggttttacatcaaggggaagatgtgacaaaaaataaacattttccagttttggagctggactgtgcacacatttctgttcagcagtattagaaccccttcaacatttggaaattataatgtttctgcagatgggaacaagctggatgccaaggagtgtgcatgagcgagagcagaggcccagcctgtgagctccactctgctctgctggcagtgatccagtgactacctaacagagagaagtggatagctttatgggcaattgtttgcccactggttgaaatgcttgggttggatttatcggaaccatggtcacataaagttgtctgtcacccaaagggaatcataaagatgccttgagtaccagagaaggatcattgatttctttggagccatagtgttcagcctctcacagctggggaactgctttgctgtgaaatagaatttcagttggatacaaaattaatcagttttcacagttcaaaattttgactaagacactgtgtcagtgtgtttggtacatgctgtgtttgagcctggaagcctacgcctcacatttgtgtagcatcgtgacaccaccaactgcctgttgatgtcatggggaaccagggtaatggggagcggacagtttctcctctgccactctagctctttctcccagcttgaatacagggctgacctttcacaaactaacacatctagaagggaccttagtgactattaatccaacactgaccaggggaagaaatccttttgcaacacccatgatcagccgctgacccaacctgtgcttgcatacttgtaataatgggggatccaccaccctacatggcagccctatggttagattttgaatgataactaggctttggtgaaattcctgtttcgtgaataaatcaaaaagaaggcaaattccatgttgtctcatctctctactggcatgagatcaatatcaaggagacaatcaatcacttatctttcatgtctctgatgtgatccatttgctatattttggtctcaaatgcttgggaagacagtagatagagaaagaaactgatacttatgatccaaaatgatctgccaaatccaatctcttgaggcaattaaattagaaggatatataggtcttcccaagaaacagaactaggcaaacataggcatttatatttggtgcaatatcctcaccctaacaaaaaaagaatgtttttctacttatatagctgatcacacagaaaggatcaacaatcgagtttttgaacataatttttcatttctcaaaaccctacttgcataaggaaaacagtctgttcacaaagagggtttcagttttgcagtgaagtgtaatgggaagaatatattcagatatgtttattaatcaagatctacccctgtctttttattctatattcgtttaggtggtccgtaacaatggggaagaaaagatgagcaagttatggcccttgtccttaaggagctcaggatctccccagtgggctgcaggaatggcaaatacccacaaaatagccgccacacaaggcagagagtgatacgtgttctactaagaatagcagtaaaatgctgaggaatcagagagatcaaggttaatgccaggtggaagactggggaaaagtacacagctgaattgactctgagttgcatgtgggaaaatggatgagatttcaaaaggcagagattaaagagttactgctacatggaggcattttcctagaatgtccctcagtataggaggcaggggctttcaaaactctgtattcatcattttctatagacatttttccttgtagtatgtcttgtcactgtatccatagctaaagttttggagatttgtatgcttatatcattgatgggattgttttaaataaatgtcttataatttagcaattttagttcctggagtcttttcacacttactgagaaatctacaaggtactcttcttggttcataggtaggtacccattgcattgacttttaattttgggtggagtctgagtgtccttattctcttttctcatggaaaaatgtcgtgccctggccagggaggaggaaaagaaaaacagcatactgctggatggctccaatctttctgtagtattgaagacagtgggagaaggaaagagagaaaaagggatgggagccgggggcggtgactcacgcctgtaatcccagcactttgggaggctgaggcgggcggatcacgaggtcaggagatggagaccacggtgaaaccccgtctctactaaaataattagctgggcctggtggcgggcgcctgtagtcccagctactcaggaggctgaggcaggagaatggcgtgaacccggaaggcggagcttgcagtgagcccagatggcatggcgtctcaaaaaaaaaaaaaaaaaaagaaaagaaaaagggatgggcctttcaatctggtgagtgcaagcaagagtcttgccatggtcagggatgtgtaaataagggcagctttctctcaatatggacattctcaatggacatttacattcattcattacgttttcctcgaagcatggaaggagtacatgctgtgtatcaggagttgccttttcaaagctcacagtctggtgaagggaaaggaaacatgtaaactggcatttgcaatgcaatatgataagggctatgacaaaaggaatgtggaattctgtgtctttgagggcagataagagagactgcaaataatagctctagaagacaatgtctgagccaagcaagaattaggtgagcaaaaagatgggcacctttttaaaaattatgggcatttagtgagtgattttataaagaaaatagcacattcattcatcttaattaagtttactttgcagttaattacgctgagtgaccttggggatatataagtatttgatacagacttaatatgaggtggatgcaaatatcactgataggtgagtgtgtgctgcaaaacgatacagagtccatctgtgtttgagtaatgataattatcaaatctcattggaagtttttcagttattgaatggaataatatgcagttcttctcttaataaaattaattcaagcatactttatattaaacaatatattttggaagaacactaccaacaaatttaccaaaacaaaaaaaataatgtcacagctctcaggaggtgccagcatttattgattacacactacatgttgttacatacattcatttatataattctcattttaaaaaatcttagctgatattgttggctactgcttacatttcatcctccgtggcctttacttcaactgaatttcagttttatgccaacaatcagcccactgtccttcacatggccgtgcatttgcttcatgaagctactcaggggaatgccaatattcagactgagaatgcttaagaggtgggcatgggactcaaatcttgttaatgaattaggagtgatgatgtttagatgtgatgcctaaaatcatggcagctatctgtgacaagggagcctagcctaaggatataaccaatgatggctcagcaggatatagccaatgatggctcagcagaatgagtcctttattttgggggatctaggtaagcaactatattagacaacctaggaaccctttcctactaaacgaggtaatgttattttccttcagatttaagccatttgtgttgagttttctgaactctcagccaaaatcattctcattgacaggtaggtactctcattatctccattttacaaatagggaaattgggggttcaataagttaagtcagcacttttggaggctatggcaggggatcacttgagcccagaagtttaaggcagcattgagccatgatcatcatgccactgtacttcatcctgggcaacaaagcaagaccctgcttctcaaacacaaagaaaaacaaacaaaaaaaagaagttaagaacttaatgaacatcatgcagctggtaaaaatatcagaattaggatcaaaatcaagtctgtcttacatcaataccctagtggttaatttgtggttagacatcttctacatatattttttgaaacatatcacactaaagcactgaaataaataatgacaaaaatgtctagtaattcaaatatataatctgtgagaaagccactttccccagtaatgttttatatcaagtgttggtaaattgtgtaaggggtcaaataataaatattttagagtttatgggtcagatggtttctttcacaactactcaactcattgcagctcaaaaagccatagacaatgcataaacagatgagctcagcactgtttcagcaaaattgtaattacaaaaacatgtggcagaccagatttgggcctgggaccatagtatactgaacacttctctacatgaactaaatctgattctttgtgaagggttcgccagggaggatgggcaaaagctcattttactaggtgtgtaccaaaaaaaaaagtcacaccagtagaagagaaaaggagatatggagtgcagtgtggaagggacagagagtgcaccctcttcacaaactttaagatatcaaagaaaatgactgttttcctactttgtagtgcagattgggaaacagcttcagacaacacaaaaggaggggagctcatggcttccaccatcagagaggcaaagttagatagtagatttctagcctactatctgtgcttaaattggaatttctgttaaaaattccgaattttctcagcaataactttcaaagaccaccacaccattatctttctttctttcttttcttttcttttttttttttttttacagtcttgttctgttgcccaggctggaatgcagtggtgcagtcttgggtcactgcaacttctgcctccctggttcaagcgattctcctgcctcagcctcccaagtagctgggattacaggtgcccaccaccacatctggctaatttttgtatctttactggagatggggttttgccatgttggccaggctaaagacaaccgttatctttcatactcaaaatattgaatgacccacaagcagtataatacatagctgttatttctgcaaatggagagataagaattggaagtgaacagatggttatagctctttgatttttgttttaattgctttccaacaatcacagagaatggaccaattttctcaataatatttgttctgaaacaaaggtctgggagtcaagtttgtcaataaggcaaagagtttttgggaggtatgtgagggtttttctttttttttctcaaatggtttgcaaaggcataacatgaaattgactgttatttatttgcagaatcttaactactgagccatatttgtccccttttacttcttactaaactggaaacataaaaaagggtttataggaaaccaaggttaacagataggaacataaagtttcactcttctttcctgcttctggcaaccactaatttattttctgtctctgtggatttgcctattctggacatttcctataaatggaattatgtaatatgcagacttatgcctactgtctttcactgagcataatgctttcaaggttcacccatgctgtagcatgcatcagtaaataatgtcttttattagtgaataatattccattggatagatgtaccaacttttttgtttattcatcacttggtggacaatggagttgcttccactttttggctactatgtgtaatatttctataaacactcataaacaagtatgaacatttgctttcaattctcttatgtgaggagtggaattgcttggtcatatggtaactctaacatcttgaggaatgatcaaacttttctgcagaagctgcaccattttactttccccagcattgtatgactattcctatttctccacattcctgccaatactcattgttgtccgttctaatgggtgtgaagtgatatttcattgtagttttgattttactttacataaacactaacaattttggacatctttttatgtgtttgttggatgtatgtatatattctttggaaaaatatctattcaaatagaaaggaaaattttaaagaagagaagatgtatgataaaatttatattgactgcatgtctataatgcattggggtctttactcataaaaatgaataataagtaatattttaatcatattacataaataagattcagataaattaagaacttgctaaagaaaatagttggctatggttaagccaagagtcaaataagatccgcacgccttccctttgtcccatgtacatatgcttcatgtgcatcgatatgaagatgtacatcttacagagatgaataagacaaacatgactgaataaagcatgagtgtgcccctctcctctctggaaaaaagtaaaaacataaaaaacttttatggaataatgcagaaaaggatcaattctctttctgatgtcaatatgatagtaaagttgtaggtagtgcacttgtgagatcatcaccttactagtgattgatgggggcatcccactctttattgatctagtctatgtaatagcacatgagaaatccatgaaccgccctgtggagggcttatttatcttttaaaatgctataaccacatccagtatctctaaacaagtgcttagaagttagaaaacattatgagtatattagccacctagacaccactctcccctgcccagcacttagcagagtgtagattgggtacatgacagtcacgcatgccttgttgctcctgggaggcagacttgccttattatctgaactgatttcctcactttccaccccaggaatcaatacagtactcagcagtcttatattagatgctccatgatagattgttaaataaatgactttaattggcatcatacagcgatattacagaattagatatacagttgatgctcaataaatatgtgctgacttatttagtaaagaaaggaaagatgtgcttggtgccaagcactgtgaaaatcccactaccacacattgtcttcttttctcatttaggcttcgtgaaaccccatgaattatatgctttcatatattcaccttattcatgttcaaaatgccagcaagtagtaaagtagtaatgcaaacccagatctgcaaaagtacattacaaagcattaagttggatatttagaactcggcacactaaatttcatctggggctaaaacacagagtcccaatgtagtaccaagaaacaagcctttcccacttttgcttaagatgacaccaacactgccatgaagaagatgaacaggggtgcacaggatgatacttcttcaaataagtgaaatgattgatgtattgggtactttatgcaagaagatttggagaacaatgtaattgttttataatctgattgcgtatccctaagacctggatgttttcaaaatgataaatgacttaatgactgaatacattctagttgcctgttttaaacaaatgtgacattttaggggttaatgctacattcttgatttcctgtatttttagtcagtaactgtattagtctgttctcacacagttatgaagaaatacctgagactgggtaatttaagaagaaaagaggtttaattgactcatagttccacatagctggggagtcctcaggaaacttacaatcacggcggaaggcacctcttcacagggcagcaggggagagaatgagggccagcagaagaaacgccagaggcttataaaaccatcagatcttgtgagaactcactcactatcacgagaacagcatgggggaggctgcctccatgatttggttacctcccaccaggtcctttccacacacggagattatggggattacgattcaagatgagatttgggtggggatacagccaaaccacttcagtaactttctctctgtttaaaaatttttaaatttctattttttttaaagtttgaacatgttgaggttcaaatgtcttaagcttccaagtgctcttttgacttttaatatatttctggagtccctttttgtcttcttggtccttaacactttggttgcatgcctgcatttcctctcctgcttgtgtgcacttctcatctgccatgtctaggaagttgtatcctttccacttgatttagcatttctttatcttctgtcgtgcagctatcaatatgccatctagggtgggggctggagatataagacagcttaaagatatcatccttttacttaaacaactatccatcttttaaagtactttaatataattttcataacttttccggtcagccagagtgaatactctcgaaagtgtctttgacagttggctttattttttgaggaggaaacttctcttgattgactttgtttgcaccgtgatttgcagacaagatactaagaatatgggggtggtggttggggctagtgttagagttagtcctgttataatctcagtttctcaacccatccaaatgagaacaccatagaagtaaaaacatatttcctatgcaaaggctgcattaagatatgtctagttcccacctcaacccactctctaagtctttcttgcataaaatgcggagccaccacaccactactgacaaaagtgccctctccacgaactctcctagaatattttttctacttctgccatgacacttgacatagttagccaatgcataagcagggcttcaagccaggctcttgtgttgcaatatctatcctttctttataccccaggtggagaagaaagtgcttggatatctgaacactagaataaatgattcaaataagagctaaaactattaaggggaaaaataagatttttaagtaattaaagtgagtgatattcattttcatgaaggaatctgaagaatcaagtcaatgtttagacattaattcaaagccatgatggaatgaaaagaaaatgtgacagagaaagtaatagaaattccctgagtcaagcactgtctttatttttgcactcacctacctccccccaatatctactttgcacagtattttagtgtgtgctcaaaaaaatgggtgttgggtgcttgctttggcagcacatatactaaaatgggaacaatacagagaaagttgtcatggccgtgcacaaggatgacatgcaaatttgtgaaacgttccctatttttatggttaatgggtacaaaaaaaaattagaaaatgtaagacctattttttgatagcacaacagggtgactatagtcaataataattgtacactttaaataactaagagtgtaataggattgtttgtaacacaaagtataaatgcttgaggagatggataccccattttccatgttgtgattattatgcattgcatacctgtatcaaagcatctcatgtaccccatgaatatatacaccagctatgtatgcccaaaatttaaaaataaaaaatatttttaacattggtgttgggtagatgggttccaagatgaatgaactactaaaaaacgatgccttctaattgctcttatttacttattctggagtgataaatagagtgtttggcaaggagaagcttgcatatgtgtagcttaaaagagtccaaaactcagcacggttggaaatgcagaatattaaagagatttctttatggagttgggcttttttgacttttccttgcctttctatggatgaggtgtgaaataataagactgttgtgtggtccctccatagttcagtttcatttctgtaaaatgaaaatgatatttatattggattaataggtttattccaagcattattactgcatgctgacttctaaagtttctcttatcccaaggttgttggtttgaattgttaaaactataagtcctaagaacagatttatttattttatatgtatatatctgttttatttttatagatttagggagtacaagtacagatttcttacattaatattttacatagcgttagagtctgggcttttagtgtactcatcacccaaaaagtgatttggtaacccaataggtagtttttcaaccctttccttcctcccaccttcccatcttttgtagtctccagtgtatattatttaccactaaatgtccatgtgtaccctttgtttagctcctggttataagtgagaatataaagtattttactctgtttctgagtttactctgtttctgagttattttacttaggatcgttgcctccagttcctgttctattgatctgtatctatttttataccagcaccatggtgttttggttactaagccttgagagtcctagatttcataaaatggtatgatttcttttttatggctgagtagtactttatggtatttatggtatatggtatttctggtgtgtgtatgtatatatatcatactatatgatatatatatatggaatatggtatttatgttatatatatgcacacacacacactcattaatcatccattaatgaatacttaaggtgattctatatctttgctattgtgaatagtgctgccaaaaatatgcaagtacagatatctttttgatataataatgatttctttcccattgggtatatactcagaagtgggattactggatcaaatggtagttctatttttagttcttggataaatctccatactgttttccataaaggttgtagcaatttacactgccatcaacaacgtattagcattcccttttctccacatcctcacaatatctgttgttttttgactttttaatattaaccattctggctggtgtaagatggtatctcactgtggttttaatttgcatttatctgatgattaatgatgttgagaatgtttttaatatgtttattggttgcttgtatgttttcttttaaaaagtgtgtgtttatgtgttttgccccctttttaatagagttatttatttttcttgttgagctgtttgagttccttgtagattccggatattagccctttgtcagatgcatagattgcaaatattttcccattctgtaggctgtctgtttactgtatttatcatttattttgctttgtagaagctttttagtttaattaactctcacttatatatttttgtttttatgatgtttgtttttgaggacttggtcataaattctttgcctaggccagtgttcagtaaagtttttcctaggttttcttcaaggatttttacagtttcaagttttacatttcagtctttaatttcatcttgagttaatttttgtatatggtaagagatatgggtatggtttcatccgtctgcatatggttatccaatttttccagaaccatttattgaatagagtgtcctctccccagtgtatatttttgttgacttagtcaaaggtcagttcatcataggtatgtggctttatcaaatctagggctctcaatgctgtagtaaccaaaacagtatggtactggaataaaaaaatagacatatagataaatggtacagaatggagaactgataaatgatttcagtaaagtttcaggatacaaaatcaacaaggaaaaatctgtggccttgctaaacaccaataataataatcaagctgagaaccaaaacaagaactcaatcctatttacaatcgttacaaaaaaatacataggcatacatttaatgaaggaagtgaaagatctctacaagcaaaactacaaaacactaatcatagatgacacaaacaaatggaaaatcaccccatgctcatggatttgaagaatcaatatcattaaaatgactgtactgcccaaagcaatgtacatattcaacaccatttgattacattaccaatgtcatttttcacaggattagaaaaaaaatcctaaaattcatgtggaaccaaaaaagggctttaatagccaaagcaatcctaaacaaccagaacaaagctggaggcatcgcatatctgtcttcacattatactaaagacagatttataccatgagagtagacctgatgtacagcagtgcacttcactaattgtattgactgttaagaaattacaataattttattctatatggtaactaaccactgctcaaatcccccctgaaaattgtccccccaatgccaccctggatgcctgggttcccaaatctcctcagtgttaatccagaaacaagagttaacatttagccccagagggacctccaggacgctgcttctctcttatgaccgtacagatttattctgattagtcctgtaatttccatatgacttattaaatattttgaacatcacatccatacatactttccagacaagaaatttggatgtgggagaacattctttaataaagaaacacataaattctcatttaaaaaaactgctttttttttctttcttttttttttattatactttaagttttagggtacatgtgcacattgtgcaggttagttacatacgtatacatgtgccatgctggtgtgctgcacccactaactcgtcatgtagcattaggtatatctcccaatgctatccctccccgctccccacaccccacaacagtccccagagtatgatattccccttcctgtgtccacgtgatctcattgttcaattcccacctatgagtgagaatatgcggtgtttggttttttgttcttgcgatagtttactgagaatgatgatttccactttcatccatgtccctacaaaggacatgaactcatcattttttacggctacatagtattccatggtgtatatgtgccacattttcttaatccagtgtatcattgttggacatttgggttggttccaagtctttgctattgtgaataatgccgcaataaacatacgtatgcatgtgtctttatagcagcatgatttgtagtcctttgggtatatacccagtaatgggatggctaggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttcatgtgttttttggctgcataaatgtcttcttttgagaagtgtccgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtaatgcctaggttttcttctagggtttttatggttttaggtctaacgtttaagtctttaatccatcttgaattcatttttgtataaggtgtaaggaagggatccagtttcagctttctacatatggctagctagttttccaaacaccatttattaaatagggaatcctttctccattgcttgtttttgtcaggtttgtcaaagatcagatagttgtagatatgtgacattatttctgagggctctgttctgttccattgatctatatctctgttttggtaccagtaccatgctgttttggttactatagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttgtatcctcttttatttccttgagcagtggtttgtagttatccttgaagaggtccttcacatcccttgtaagttggattcctaggtattttattctctttgaagcaattgtgaatgggagttcactcatgatttggctctctgtttatctgttgttggtgtataagaatgcttgtgatttttgtacattgattttgtatcctgagactttgctgaagttgcttatcagcttaagcagattttgggctgagacaatgcggttttctagatatacaatcatgtcatctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatatctaatttattgagagtttttagcatgaagggttgttgaattttgtcaaaggctttttctgcatctattgagataatcatgtggtttttgtctttggctctgtttatatgctcgattatatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgagtctctgcccagctttggtatcagaatgatgctggcctcataaaacgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaatttcttcctggtttagtcttgggagagtgtatgtgtcaaggaatttatccatttcttctagattttctagtttatttgtgtagaggtgtttgtagtattctgtgatggtagtttgtatttctgtgggatcggtggtgatatcccctttatcattttttattgcgtctatttgattcttctctctttttttctttattagtcttgctagctgtctatcaattttgttgatcctttcaaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatacatcccagagattctggtatgttgtgtctttgttctcgttggtttcaaagaacatctttatttctgccttcatttcgttatgtacccagtagtcattcaggagcaggttgttcagtttccatgaagttgagtggttttgagtgacattcttaatcctgagttctagtttgattgcactgtggtctgagagacagtttgttataatctctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattggtctgtctaatgttgacagtggggtgttaaagtctcccattattattgtgtgggagtctaagtctctttgtaggtcactcaggacttgctttatgaatctgaatgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttcccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacattttggcatgattttgcagcagctggtacctgttgttcttttccatgtttagcgcttccttcaacagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacctgacctttctctctggctgctcttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggctccattctccccatcactttcaggtacaccaatcagacgtagatttggtcttttcacatagtcccatatttcttggaggctttgctcatttctttttattcttttttctctaaacttcccatctcacttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcttctaaagccttctctcagctcgtcaaagtcattctccatccagctttgtttcgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacgggaccctcagctgcaggtctgttggaataccctgccttgtgagatgtcagtgtgcccctgctggggggtgcctcccagttaggctgctcgggggtcaggggtcagggacccacttgaggaggcagtctgcccgttctcagatctccagctgcgtactgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcccggctgctttgtttacctaagcaagcctgggcaatggcgggcgcccctcccccaacctcgctgccgccttgcagtttgatctcagactgctgtgctagcaatcagggagactccgtgggcgtaggaccctccgagccaggtgcgggatagaatctcttggtgtgccgttttttaagccagtcggaaaagcgcagtattcgggtgggagtgacccgattttccaggtgtgtctgtcacccctttctttgactcagaaacggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcggaaatcaccgtcttctgcgtcgctcacgctgggagctgtagaccagggctgttcctattcggccatcttggctcctcaaaaaaactgcttttttacacggaacccacgaacatgaaaaaataaaaaaaccttgattattagcctcaggtatgttcacaaaagtatagatatgtttttcatcattcatttccaaaaacattatcagagatttggagcaaaaaggtgctgttaccttatcattctgaagttttgtgtatgcctatgatgttggtataattttcattgttacaaccattatgatacttattcacagaaagcgtgcattaagcacttattgtgtgtcaggctttgtaataaattatggtgatacagagactgacttgctaggtccctaagatcccataatctagtttgagaagagtatggagaaggaacatgtaagcagttaaactgcaattcagagtgatcatcacagtattagagatgaacaggaagtgtgcctggagctctgaatactttcagccacttctaacctgaggagctagggaaaacttcagtatgtgcttacatttcacataaatctgaaacaattagaaattatttgttagagacatacatgtagctgtgtatgaggtaaagggaatagcacatttaaattcatagagtctaaaagtcgccatatgtgttccagtattattggagctcaagaaatgtgggaaagagactaggaagtgcagtcccagggagccttctctgatggcttgtgtggggaattgctgaataagctagaaagggtttatcaatctcgtgtaatgaagactcaatggagttttagccacaatatggagagctcacatgtgctattgaggtggttgtgttaactcttcttttttttttttttagatggagtcttgtgctgtcacccaggctggagtgctgtggcgcgatctcggctcactgcaagctccgcctcctgggttcacgccattctcctgcctcagcctcccaagtagctgggactacaggcgcccgccaccatgcctggctaatttttttgtgtatttttggtagaaacggggtttcaccgtgttagccaggatggtcttgatctcctgacctcgagatctgcccgcctcggcctcccaaagtgctgggattacaggcgtgagccactcgcacccggccgtgttaactcttagtaagtagtagaagccagtgtgaggtacagggagaccagacaggaggctgtttctatgtgtgagaaacttttatccactagaagttcatataaagacacatttgggaaataaagttgttgtagagaaagatacaccatccccaccgtggatagcatccagattaatgctggaaatcacatttcaattagaaaattgcttaggaaacatgatgtcagaagaaggagagccatgtaattcaagtctttggtggcatctctttcaagtttcccagtgcacctgactcagaagatagaatcagtctgttagctgaggtctctctgtgctggagaagcatgaaaagggccccaccagcatagactcagttctctttgaagtttaagatccatctacaaatggccatgttctttccttagcagaaggtattggggtttctacatacatgctactcactgctcacgtgtaagtaaggtaaaatttgagcaagtggaaaatgaccctgctgtaatccagatcataatatttctaaataagcacacacaatagtcaaccaacctacttcatgatcttttatggaacaaggcagagacaaggccactctgcacccacaaaaatgtataagtatgcacttctgacctatgtgaggtaagtgtctgctacttctctgtcaatggcaagccctactaccgtcctccagcatattggatttgtaggccactcagttagcaattgtcttcacttctacatagcattcaatccttaatgtactcctgcttttcttagcctatagagtagttcaaactcccagggaggctgttttgttagaaggaatgaagtcactatggatatattgaaaatctcatctacaatagttaaaagtccataatttagggttagtgtgaggatattcattcaataagtatttactgaataactattggatagcaggtgatgagttagttattaggaatacatatacccacatacatgcacaaacacacacacacatacagacacatacacagatatataacatgtttgtatcttccagaagcatacggtttatgggataaacaaagggagataatgaaggttattatttctagtagcaagtttgagaatatcccatagggtgaggctcatttttgttagactttgataaatcatctcaaaggctaggcctcccagacgtgtgtgttatctgtggctcaagactatgagtagcagtcatagctatgattgaaagaatgagagacaaagagcagaaagagtggggagtagttctgtgacctaaatggtgaaaaggccccagagaagaaagcctttactgggcaacactatagagagttttgtagagaacagaaatatccaatgggaatttattttttgctaaagttttctctgtcttataatatgttatctggatgaaatctgtggacaactgtgggattgtgggggtgcaaggtggcaacctgcagagcaaagcatgtgcaaaggcctgaggggacatgggaaatttaaacaattgtggcttgtgtattgaaagtggggggcagttattatgtatgagatgaggagtgagagacacagagggcttgggaagattttggtcttcatcgtaagagccgagataagccatgacatgattttttgaacagcagtgactgattgctatgtggtttttttttttttttgcatatattatggaaacagattttattgtaaataattcattttagggtgggtagcatgtgcacagacaggtctgtaaggaatattccaggtaagatgagatggaaagaagtggtaaattcaaaagatatttaggagttagaatcaagagtatttggtgattgcgcatgcaggatcaagagaatggctactaggtttctggcctggacaatgggatcagtggtgtcacattaactgagactgggagtgctaaagtgcaagtttcttgaggaagagcaagaattccattttctataagcaaattctgagctgcttttgggatgtccatcaagaggggaaagataagcacagtgtgctgcattgtgccagcaacatagaaacctccgtaagtaatattcaggttcaactcagtagttaatattcaggttcaactcagtagttaaggaagaaaccagtcatcgtttcaattcattaataaattaactttcattgcaaaatctgtggggatttctgtcttccaacccaacattttcttcccattttgcctttaatgaattcaccaccaccacctctcactgtgcatttaattactctactgattacttactatgtatgctacgtgatgtggaaagaatagaaaacttaaaagcaaagcactctccctgacctccctggggatagagaccgaaacgtataaaaaaaataagaaaacacattaaactacatgtaacaagtgccagatgagtgatccagataattgcacagtccctgtggcccctagtgatggggtactatttctaatgccagcagcagtgcttccttaaactgatccctagaccttggtcatggtgcttggaaaaccctttcttagcaccatctctgctcatcttaatcctaacactcctttattcttcctgtccctctttttttggaaaatcctttccaattgttttgctttgttttcttctcgtttgtcctctatgctgctgggctgatttttccctcctttaatgaaattccatgctctttctctaagttgttttggagcccttcttatatcctaacttacttcgcttcccagaaatttttaaaatagagtttttgttcactataacactttttttttttttttttttttttcctgttttgagacagggcctcactcagccctgtctcaaacaggctggggtgcagtggcgcaataccagctcactgcaacctcgacctcctgggctcaggtgatcctcccacctcagccttctgagtagctggggtcacaggcgtgcgccaccatgcccaaataatttattattattattatttgtatagatgggggtctccctatgttgtcgaggctggtcacagactcctgggttcaagtgatcctcccaccttggctcctgtagttctgagatacaggtgtgagccagagtgcctggcctgtgataccactttttaacacaaacaattagaaaaatgctgtataaaaaagttgtccttttttttttttttgacagagtttcgctcttgttacccaggctagagtgcaatggcgcaatctcagcccgctgcaacctccacctcatgggttcaagtgattctcctgcctcagccttccaagtaactgtgaatacaggtgcctgccaccatgcctggctaattttttgtatttttagtagagacagggtttcaccatgttggccaggctggtctccaactcctgatctcaggtgatccacccatcttggcctcccaaattgctatgattatggatgtgagccaccgcgctgggccaaaatttctcccttctgtaaattcctattccgtgcctctgtgtcatgccatccataagcccaaggattaaagatgtgaagacctgctctgctcagtggaagcaagctcatggtccagtcagacagtcagatgggagcttcagaagctgatggatgtggagagaatgatgtctgatagcagggcccactctgaaataagggaacttaaagaaagccttgaaatacaaattggtattcacgggaacataaggcccctcctgtttacttacaggaaccttcatccatataattgttttgaaggcaatagctctataacaaattatttaccaaattacattcctagaaacagaagtttgattaagtacatgccaaaatagtaccatatagcatagccagcttagtgtattggactgtcttaaaagtggcatagctttaaaaaatataaacaagcttccaaaagtgttgaatttgctcacagatgagagtttttgattactaagatacaccaaggttgtttaggatcataacttttatagtttggcattagatcttatccatgttctcattctcacaaatgttccgtgtttcttcttcagaataaaacactcagctggatacattagagcacactgtgccaccttagggcacagaaagaaaataaagaattgcaccttacattttatttttggctcattcttatttatgttctattttatgtgttttgtagtgtatcttgtatgttgaaaattaaacaaatagatgtatgaatacatacatgaactttaatcagatgtacaaatgtaggaggatatcatccaaaattattagcatctctttagtaggctttgtttggttgtaagtgatagaaaacctcagtaagagtgacttggacacagtatgcttattatttagtcaagaaaaatctaagtaggtggtcttagagttagcgtagcaacctcgtgagtttattaagggtccagaatttgcctatatttccatacacatattttgcatgatgactttcaagaataaaatttcacctcatgatgaattacacttaccttagccaatgcctctgtgatttcaggtgggtaatactatgtagataatatatagtaaaatgcataggtatattctaaggtttcaaatgtattgataattgcagttatttacttagagaatgatcatacccaatattttattattgtttattatattgtcattaaaaagttataataatgttgttttctttgaattcagtaaagtcattgtgaaggttaagcatgtgcattttaaattaatttggagattctttaagctatggaaatggaaagcctcagtacatgttaagcctgatatctgagctttcccaccccagacttttgcagagccattgacttgggtctctgatcctctgtaatgtgctgatagatgataacatgatggagaaatcagttggtagaatggggcggtaaccactagagatagcagttgtcagatggaaattaattgattgtaattgctttgccattgtattgcacttgaagtctgtagcttgttaaaaccactgattataaaataaggatctcactttttatgctgtagattatgttaatgaaagctgttcttagaagcatgatcagtgaatatcaataaatggataataagaaattaaaggaaaagttaactaactgatcatgagttaatatacttcagcagccagagtagcagtcaactgtgcaccgtttcatattgaattttttgctcagagctcttgaattttaaatatttcccatagagagattgattctgtgtgactgtttatcacgtactgtcttgaataacagatcttttctgtagagaatctcctgcaagatggaaaatgtgtgtgttttgcagagcctttattttgtgccaaagtattaacaagcagatattttgaaatggaaaacataagttcccattgcaataccaatagtggtttatttcagtgctcgtggaatatgagtaacatatgtgtgagggtctgtgtgaatctgaaggccttgctgttgcaatctttatcaatattataaaaagtatactaaaatgataacataaatgttaaattatacttcactttttgctgtacaaaatgcgttaacttttataaaattataatgaggtttttaattatagctttcatttatagcatttaattgttgatgttagagagatcagagattttggagatatttttctgaacaccagttctcattaagcctccatgcaggccctcaaggaccttacagaagaaaggaacagataaaacaaagaaaggattacttgcagtgttgaatgcagtgatgaaagtgataagaggcactgggaggcacaagatgagatcatctaagttctgaggatttctgggtgtcttcaacaaagaatgaaggtctgggaagaaggagcagtgtgacagttcttggtattttggggaaatagaatgatagttgaaaattaagttgcataaagttttagagtgcaagaagagaccagacagataaacatatagatggcccatgccctggtttgccctactgtggattttaaagttattcccacaggagagcccatgaggatttttagatgtgggagagacaggggtgagtttccttttaaactgctcgctcaccatcagttgtgacgataatcagggaagaagctcattgtgaccttcatttactgtcttagtccattttctattgctttaactgaatacccgaagctaggtaatttataaagaaaatacatttattttttgcagttttggaggctgggaagtctaaggtcaaggggctgcatctgctgagggcattcttgctggcaaggactctgcaagccctgaggcagtgcagggcatcacatggatagggagtaagagcatgtcaactcagtccttctttctcttcttgaacagccaacagttccatcatgggggcctcaccctgatgaccttatccattcctgattacctcccaaagggccccatcttcaaatatcatcaacatatgattttgaggattaattttccaacacatggaatttgggagacacattaaaacaagagcggttaataagctggtataatatcccatgcttgaatattattattaatctaaatctctgtaaaggaaattaaaagcttaagcattgaataattttttcttctttgactttttaagtatattttttgttgaatgttgtggtggaattggagctaatagttgcttaaaactctgtaattggaacaatgtctacatgtggtaatagagtctgtatcttatagatagcacttatttattgttattctcatatttgggatgcagatattgatgtataacttaatttgaaaatgtaagtaattatgattttaagaatgcatgtttaagatatgctaaaaaatggcaataattggtcctgttaaatatttaccagaaacattcttcatatttgagaatctgtttcagaatttagaacatttgcattttaattacataataaaaggagaaagtgaaagaataattggcttagctattagccaattatagctgtaactgaaaaaaaaatcccccaaactgacattggattccacagaacagtcacaatatacattgatcagatgtttaattatatttggcagcaataaagggaagggaatgttgtttcaatccttcatacaacatgtttgttaaaactgaaattaatgagggtggatttggggtgtttgacttaggatcattcagcttttagtgtttacttgtccacaaatggggcttctccagagtgactccaatagataaaatttagtggagaaataagacaattgaatatagtggttacagccagctgcatttggtcagtaccaaggagggttggagctgtctgtctagagtcccagaggtcagagcccatgagaaggcctccatacagagatccagagccagtgacaggagttgttggtgtcagaatgtactgctgacagcgtttccccctgtgctttccctgacagatacgacgacatattccacagagcgatccgagcacttcaaaccctgccgagacaaggaccttgcatactgtctcaatgatggcgagtgctttgtgatcgaaaccctgaccggatcccataaacactgtcggtaagccactgaggccactgatggaaagggcaggcccgttgcaaggcgtgggggtggagggtgctggcagcatctggtatgtgtcatatccgggatacacacagtcccaccgtttgaatagcagaattgcgagtcttaatttggaaagggcaaggctgctgcctctttaacagtggaagaagacaaaatggaaacaaagtagttacggtttaagttttacctgaccaagcaaacaaagatttacttttagatctgcaaagttaatggaaataattatttacacactttagaagcgtctgtttatgatgtggagcttaggcatatatcctagtactcagaaataatctgttcttgagaacctacagactgtggcaggagaagcaaactgctcatctaagatctagaatctcagtgtttattgtgaaccaaccccagagacttgaactgtgtccagagagaactgcattttattttgtttctgccttcctttattaatttcagtactttttcttaacacctctgatgaaacactctccagcaagaagttgtaaatgaaatagtagtcctgttatagtctaggtagagaactacttggggaaaactcccagtagagatcaggaaggtgtttaattggtttttagagacataaggttatgtaactgctaaaaataaaaacaaggggggataaagagtgcacttatagacactgtggctttaagactcaatagaagaatcaaattaacatctgaaaaatatttcttaccaagctttcatttccagtattaccctggtaatttgtttttctttgcaattgtgtatgcatcagtgatcatatatatccacaccccttttcttctctttatttactcttctcgtatgacacagttattaaattaattattctgaatagtgaggcatggaaaattatgacttttttctattactattataaaactctattcccatgttgtttcactaagatggtgtagagaaatgcattgtatagttatgaacttagaacatgccatgccagcagaagctgcctggatccaagagccaggtttagtccacagggaagatgtattgccacactgagcaatggcacaggtttggaagaacagatacgtgatatagtaggagggctctgtaaaagttaccatatgtcctgtgtcaggacaaatagaactgtgacctttcctcacccctgacatgtggtgttcatatatgactttggcagtgccgctgcattcaccctagttacaaaatttgcaccctattcctatgctctgcaaacctgggttggggaagaaggggagtggggattgtttctctccacactcctcctctctcatatttattgtgactgtgcatgtatggatacaaagcacacaagtgacattaagaccttaagggaaaatccaggaatgagctactccttcaaagcgtgatgtgcatgcaagctcttttagatcctcaaccatgttacagtggccaatctaatgggataatcatttggaagtggccaatgcaatcaattatgtttgaattcgtaatcaattgaagaagggatgaatcagaagcattagctaaagtagtggctttctttgatggtgttttaccaagaggaggaatcagatcaggtcccaccacagtatgcaggctgagatgattcatcttttccaaaaactgagactatcaggagaacaaagtaattcttctttttctgcatatggctatgctgtattcttcattacttcatgagtgtatgaatttgctaggactgctgttacaaagtgctacagactgggtggcttcactatggaaatttactttctcacagtcccggaggtcagaattccaagatcaaggtgtcagcagagttgattccttttgaggcctccctccttgacttatagatggtcaaggagatgtaccttattatgtttcctctgtaggtgtttgtgttcagagttgattccttttgaggcctccctccttgacttatagatggtcaaggagatgtatcttctcatcatgtttcctctgtaggtgtgtgtgttccaaatttcctctaaggacatcagccatattagattagatcacatcctcattaccttattttaacttcattacttctgtgaagacctttctccaaatatgatcacattctgaggaactggagtttacttcatgtagggattttatatttttgtagataaattcagtccataacaatgagtctcatgtccataaaagaaaaatcctttgcttttgtgagatgcatgtacatctctaatttttgtaacacacataagcagatatatacctatagtttaagtgaaatgatgtacatatttaataattttggccttctgtcttcatatttcttgcatatttcagtacagacagcctgttatttaacatagactcacaacatagctaatcatgacaaaagactagcctaagacaaaattggaactcgagtaggttaatagatgcctataaatctcctactggtgtgtatgaataaatcacacatcacatgtgcctgctattcatctctcaagctttgctgtgaataaaaggcttacatttgttcctgcatcagccacttctaaaaattccaatgtagttattaataaagtgccattttgtacagcactctatttaagtagtatgtttcagtcatactcctattcaacaaatgtttactgagcacctcctatcactaagatactattgaataaatacatacagaaatgaatttaaaaattaaatgtcacagtgctttgtaatgtgtttggagtaagaaaaatacttcatcgttaggaaattttaaaaagcaaaatacttcagtgactgacatgctaccaggagtatgtttatgacatagtagttactggattttgtttcaagttaaataagatgccatttaatagatctgagcagcaatataaaggcttatgcatgaccctggcttattcaatagtttatttttttgtgtctcaaaagattagacatctaaatctgaaagaaattaaaattatatttcctagattaaaaaaaattgtaatcctataataaactgcatcaaatatttttctgtgttgtgaaaatagaccatgctctgacacatttctgttttcttctcaaggaacgataagaacacaattaccaaactattcgtgatagaaatcctgaaagtacatgcaaaaaaaaaaaaaaaaaaaaaaaaaaaaaaggacaataataatcccagaaaagggaggagttgaaagtgggggacatgtttgtttcttcataattttcttattccagttcttcaagaaacacttgtggtaccagtacttagaaattataaagcaatttaattaaaaaaaaaaaacttgacagaaggatttttaaagaacaagaaatagagaaaatagattttcctaaattcaaaatataatgtgtatatatatatgtgtgtgtgtgtgtgtgtgtgtgtgtgtgtgtgtgtgtgtgtgtattttatttttctgagagggacccttgctctgtcactcaggttggagcacagtggtatgatcttggctcactgcagcctcaatctcctgagctcaggccattctccctacacagccttctgagtagctgggactacaggtgctcaccaccatgcccagataatttctgggtttttttttttttttttttttcgtagaaatggggcctcactaggttgcccaggctggtctccaactcctggacttaagtgatcctcctgcctcagcttcctaaaatgttgggattacaggtgtgagttactatgcccagcctgaaaatataaagccacagattatccacaggctaattagtgaaaacagattgtggtatattgtgggacttagtatagaacaaggcttgattcataaaccagaggaaaatgagagactgattgttcaataaatgattgactatcaggtaaatagaatcagaagtgtatgttgacccctctttctataccaaaagtatactaatgatttcaaaagttaatgtaataaacaaataaagcctaaggaaaataataagtaaaattacatgtttatttatgttcagcaattgtaaggaccttgtgagcaaataaaagcaatggaaggcaaaaattaacaactttgacacagcatttttttatctgaatatcataaatcagaaacaaaattaaaagacaaactgtgaggaaaccgaataacaaatatggcaaagaattaaaaccctgaagaagtcatgtagatcaaagggtaacattaaaataaaagctcaatagggaaattgacaaaggggaggaacataatctatctaaaaagaaatacagataaccagcaaacaaatatactcagcctcacagagaaatgcaaattaggtgtttttttcctatcctttatttaaagatttttaaaagtgactactatacccagtttggtaagggggctgtgaaaacacgtgtccacaaatactacttgagggagtgcactttgttaaatattttttgtaggtaatattttagtatgttttaaaagccttatactgttttttgtttgtttgtttgtttgtttgttttttgagacggagtctcgctctgtcacccaggctggagtgcggtggcgtgatctaggctcactgcaaactccgcttcccaggttcacgccattctcctgcctcagcctccctggtagctgggactacaggcacctgccaccacacctggctgattttttgtagttttttagtagagacggggtttcactgtgttagccaggatggtctcaatctcctgacctcgtgatccacccacctcagcctcccaaagtgctgggattacaggcgtgagccaccacacctggcccatagacatgcttgtgaatatttatttgtagggatgctcaccacatttttatctgtaatagcaaaaatttttaacaagtatgaattatgaatttaaatgtctatataaattagaatatatttgtacattgaatgaattttcacagtgttttgaggatatccaatggtcactatgtcatgttaggtataaaaatgtaatatgaaattgcaaacttgaacatatagtagaatcctaattctgaaaaaaaaactaaaaaggttgatagtttacaactatttccttctttcaacttggcaaattttctaacatctctatattacacatatatttcatttatgtaacacccggttaagagagttgactcctgcctctagtctttccattaagaaatatagatagtgtccttgtctctttaaaatcaaggtcattataattcactattattgagctgataagagaactttcaattaagtgcttccagattaagcactactaagtctatttgaatgtgtctgctccttcttttattaataattcattgatactttttataataattctttttcatgttgaaatcatgttttgaaaacattaaaaacattggatttaataaaaggtagatacaccccatagaaatgaagctggatgaagaaggaaaataagtcagcagaaacactttgaatcaaaatattctgaataaaatcagaatattctatgatcttttcatttttatgccatttctagaaattttaaaaatgttggcaatggtgctatgtataatatactgcactagattgaaaagaggtagccactgtaattgaaaagattgctacacatttgaatggaccaaatgtgttttaagaccaaattcaagtaaaaaggatgtgtctcttctgaactgaagctcattaaatgtttcaccggccttcctgcaaaaatggattttcaaaactttggaaaggatagcatttaagctgaatttgacctgtattgaccattttggaaatcagccaagcaattcgcttgaagatacttgaagcacttgaaatatggaattgctggaaaaagaataagacagcccaatagctaccattgcccagggtgatactttggtaacaggactgatggcttgtataacaatctgacatgctgataggagttggggagtgggggcagccattgggaagggcaaagggaaccctaagagtagttttttctccctattatgactggctgtctctgagtaggttttgaaataaaagcttccatttttaagagaattgattggtcattgcgtaacgacaattctacgatataacaggaccatcccagttagtgctttgccctgtcactttggaggtccattagctcttccattcagtgagggtcctctatatcaaatggttctccagtaagtgctctgagagcagcagctaatgattccctgtggttgaagcaagtcagaatgaaaatggagttttggcacacatccctgaattccatcgacaggagggaatgaaggctaaaatatctataaatccaggccaggctgcagagtcactgcagattccctgcagagtggtgttaataacaaggtgaagaaccttagaagaatttgcaagttcatcaaagaagtgttcatgggaatgattgccatagcccagacataatttaagtaatttgcaatagccatattgataacaggtggtctaccgattgcttttgacaagaggaaatgaagaaagttataattattcttcctctctgtggacatagcttgtcatgatagtcttagaaactcggaaagcaagcaaaccaacaacacaatgaatgttattttgtaattccatgacacttaagcagtggtttacctcttctaattcgacctctttgtattaaaattagttggcagttagtacattgctttggatatggatatttaagtatcatgcaaaaaaacaaaaaagcacattcaaccaacacatcatttagttattagccaaagattactttattttaatgttttcttctgtgattggaatttagttattagccaaagattactttattttaatgttttcttctgtgattggaatttagttattagccaaagattaccttattttaatgttttcttctgtgattagtggctctatctgaagcaggaaatggtgttttttaaggaggtcattatgacttgggtttgcttttgtatccaagaattgacacaaatttgtttatttaaaataccttccctgtgtgagttggggtaagacatacaagaggcaaatgtgagtgttcaaagctgagagacctgagttcaaagtcctactcagctttctactaactctgattttttgcaagtcatttaatcagaaccttcaatatttaatttttttaagatagtctaatagttgccccaaaaggccaatgaaagaattgaaagcaacatatagaaaactatgactgtgaaatagatactatgtatatatatgatagctctttcctctctcctttatgctcatattgaagccaaggaaaagcatatttcaagaatcccgtgagagaaattgtaccagtatcatctgccttatttaattaacaggagacttcggtttaaaagtggggaggggcatgccagagaattcctgtctactgtatattctcaggactcagaattcctatcgctaattttaatactttgacaaattagcaattttctattatttgttacattctgcaagcatttcttgatttttccctcattgcttttcttaacgactcttcatgggtttaaaggaaatattatttttcctttcctacttaatcagcgtaacgggccataattgtgtcaataacatgaaattgttgtcgattttgcaattttgtgacacaatacaataggctgttgacttttttatttttttattttttttgcagaaaagaaaaatacactttcatgtgaaaatgtacacactgaaaattatagattttacttgtggaaaatatatgattcaagaaaaatgaagtgatttacttttttcttaattctttcccaaaatagttttctgaaagtttagctatctgtatacttcagtgtttaaaatatgtaggcactaaaattcttaatggcataaaataaaaataatctgctttacgaaagcctacagaaaataatttaaaaggaacattttttaaacgcaggatatgttagcagcgaatatggaacccaagataagcaaggcgtgttcgactctacctagacagtgtcagatctctggcagttagtacattgctttggatatgtagcttttagctgctctcctttgtaagttttaagaccaggcttgtttatgtataactattcaatgtcatacacacacggagacgtgcacacactctttttgtttgctcccatgatgatttatttaccagctgtaaaatggggatgatgataactgtccttcctggcagtcattggaccataatatatgtgaatgtcaattggaagttgtaaaatgccatataaatgcaagatattgtagctatgcaaaacctaaaattacctaattgattttggtctgtcccttaacccttataatgagagtgctagcaactaaaacaccttgaaaattactggagtgtttttatagccaatagactccagaatttatatagcacttagaactttatcaaactttctttgtactagtctgattatttaaagaagatctcactatataatgatgtctttaaaatatttaattttaaaaagataaaaatctttttaaaagataaatattttttaaagataaataagaatatttttatttccttgcagactctttaaaaagtgttgtctttttgtcttctgtttttcctaataattcttatttggtctggctggttggattcaatgctccactgctactagcagacaaattatacatattcttgaccgaacgtggtggctcacgcttgtaatcccagaacttaggaggctgaggtgggcagatcacatgaccttgggagttcaagaccagcctggccaacgtggcaaaacccagtctccactaaaaatacaaaatattagccaggtgtggtgatgcatgcctgtaatctcagctacttgggaagctgaggcacaagagtcacttgaacctagaaggtggaactttcaaggatgcaataagccgagatcataccactgcactccagcctaggtgacagagtgagactccatctctaaataaataaataagtaaataaataaataaataaaacatattctctgtgattcagttttcttatctgtgaagtgggaaaaacaatattactacttcccaggattatttgaggcttgatataggtaaagttgagatgcctggtattgagtaaacacagggaatttggggtaagtccagtataatatagtaagttacaggtattgttactttatctgcacagctttgttgacaggtcagtgtacttgtgtcagaacttcttgataggtactcagagtctcccagcacagtgagtcttgtgcagagagttcaatttagatccactaatgggaataaaagagaacaggcacagatacattatttaaaaacacaataataccagatcgtgcacaagaacacattttagaatcaaggatcattgtaattattcaagtagtaaacttaaaagacaggcagaaataggaggccaccttttgttaggggaatgctcccttttgacagttcctgaagaaaaaacatgggaaaaacactccttaccacctacagtttaggccattcctgctgttgacccttcagatgtgtccccgaactgcctcaccaggcacctgcttcctgcctgagagtttcactatcttgtgagggatgggacagtctggaagcttctcccatgcagacagagcagagagagaattatgcaatattttgtatcccagataaaattatatagtttaagtggattatggattatttcaccaaatttattttaaaaattaagaacatatccataaatattattttagccagagatgatctatcagtacaaatgtgaacagtaaccttggtaccacaggccccgccgtgcaagcttcttgggtaaatatttcaataaaaccttctcaaaacaggataaagatggctcagctgttctgtggactctgccgaggcaatgagggaatttgccgtgtccttctgtggtctgcccatctctggggctactgaaaggattcttcctccaacctaagtttcacagcatcaggcagcacttctgggttcctgagcatgctatttctttccaaatcacttttgtctgatcatcatttacaaacataaaagatggcttaagggccaaatcacaatttttatgcgtaaaccaaaatgtcagtgtttgtgtaccagactagggaggctgacaccaggttctacatgcttcgcctccccactaaactctctcctttattgtcccagtggttcaggaattcaaactgcttcaaaataagacatttaaactctggctttatgtactctacttatttttagagataggttcttgctctattgcttaggttgcagtgcactggtacagtcatggctcactgcagccttgacctcctgggctcaagtgatcctccttcctcagcctcccaagtcactgggactacaagtgcacaccatcatgcctggctaattttttaaagtttttgtactggtggggtctcagtatgtggcccaggctggtcacaaactcctggccacaagtgatcctccttccttggcttcccaaagtgctgggattataggtgtaaaccacggtgcctggcttagctcccaaaacttttcaggcataatgggaaattttaataactttctctgtaaaataagcataatccaaggatgttccatgatgagtatgacatatacttgacctaattataatttgattacactcaaattcatagaaaagcaagactatcatatactatgtggatttttcttaatgtaactttcaccagaatgtacaacctctgtattgttatccccactttgcagaaatcagctgtgagtttcctgagtcactcagtgctagcaggctttggatgataatgaaacgagagagttccctgacatatgacaggggtgtggctcacctgtttttggtcgtcccccagctgaaacccctgaaggaggggaagcatgcagaagggcagtgcagaggcgggggcaggtgctttggctccacagtggtgtctggaggtggatacctgcaaccctccacgttacaaagctctttcagttttgccatctgcagatggcttgagtgttaatcagctcagtggaccctctgctttatcgcaagggcagggggccagtgtgacagccttctgtatcccaagctcttgcccagtggctcagaagaattggatcacatgcaggctggaaggatgagtgcaaggttttgttgagtggtggaggtggctctcagcgagatgatgaggagctgaaagtggggatggagtgggaaggtgatattcccctggagtggggctgcccagtggccagcctcctccagtcaccccctgctgaactcccctcagcatccagacatccctcctcttctctttctctgccgcgtcgttctgccattgctgatctgctggtctgccctggagcttgtggttcagggtttatatgggggcaggataggggaatggaaagccaaaaggcaactttttgggcatgaaaacagaaatgcctattcttattcagggatgcgggcatctaggcttaaaggtggggcctttgccagggaaccaccctcttcaacccagtattttcccatttcctgtccgtatcaataaggtagaagagagcgccctaaaacccattcttttcactgtatcccaactctgtgtcagtgcacgttaacatccaactactcttttatttcgttacctatgtacctacgtattacttgagaaaactaaaaaattgacagaagggccaagcattccttgttttatagaaaaaagccaaagacagtgtttccagagtttatctcagagtaaatctctaaaaatatgtttatttttttaatgctcacagcgattctggtggctttatgaatatcaggaaaatatttctactaaaggcagcttaaaatccaccttacaaacacacacacacacacacacacacacattcacacacatgcatatacacacagtctgtttactaggtatctggcatcatgcaagacactgaggttcagtggcaaatgagaccaaaagttccttcttgtcaataacttgctataagagcactgggaagccaacagaatctagtgtggaagggaacacaatgggcagattctgaccatactgggcagtgaagctcatatttgggattatagggaaacgcattctaggctggtaaactgagggaaaatatcttcctcaactatataaaatccctcatgcaagttttatcaaatgagaaattaaggataaagtgaaaggaataaaaaagatgagagcattacacctggtttggggaatatgtttttagaaatatacatgccatatgtgaggctatagaatggcactttttgttctattttatgtacactcagaagtaaatgacaatttaatacattcttttatcattctgccaatgtttattaagcattttcaatgttccgagtccactgtaaagtggtaagaatatagtgatgaatgttctcagaaaaactcataagagaggggttgagttggatattttctacttcaattcaatatgacaagttctgtgatagatatgagctatgctcatatctgttttgtgttgctgtaaaggaatacctgaggctgggtaatttataaagaaaaaaaaggtttctttggctcatgattctgatagttgggaggttcatgattgggcatctgcatttggtgaaggtctcagggtgcttccactcctggaggaaggtgaaggggagcattatgtgcagagatcacacaaggaaagagggaaccagtggtgaggtgccaggcttttttcaacacacagttctcttgggaactaaagaatgagagcgcactctcctctgagggaaggcatcaatctgttaatgagacatctgctctcatgactcaaatacctcccaataggcccctcctcccaacacccccacaatgggggtctaatttcaacatgagagtatgtggggacaaacaaaccatatccaaatcatagcactcatatgtacatagaagattccaaaaatcagtgctcatgaagccaggacgggcttcagagaggagataacacattaatttgcatttggaaagataagagcctttttatttctcatttggaagcctactcttgctggccaacaaaggcttggagagttgagctgctattggagaagtttctctttaaatccaagagggagggaaatttcaaaattactttagatgcaattagaagtaatcagcttcatgtcataaatttttgatgcaattggtcccttcctttctggattattttttctctcatgtccagatggttctcacaaacatatcagaagatgatgacatttttaatttctttcactcaagctctgaatttatctgaatggaaagtatagagaagagtgcgattcttcaagcctaacaagtatatcacactgattaaattatgaaattaagattttttaaattcaaaattaatgtataacttttatctacatatttgagatattcacaaagacaattttattgttccaatcaaaaattaattgtattaacattttattattcatgtatttatttatcctgagagtcttgctgtgttgcccaggccagagtacagtggggcaattttggctcactgcaacctccacctccctgggtcaagcaattctcctgcctcagcctcccacctagctgagattacaggcatgcaccaccatgctcagctaattgtagtatttttagtaaagacagggtttcgccatgttggccaggctggtctcaaactccaggcctcaagggatccactcaccttggcctccctaagtgctgggattacgggcatgcgccaccacacctggcctgtattagcattttagatgtaggaaatgatttttcagttctaaaattttcctaaagaattaaacatatccacttaaggatgcgttgaccactgatcattgttgaataatgaaactttagggatacttactggcacattcaagtgaaaatgttctacaattccctaggtagtatttcttttctctaactgagctgctgcgaggctcgcatagggtgaaagtaaggtaactgtaaaggatgtaccttgttatgggtcaggcagcaggttaccatattggcacatatagcaacacatgcatacagcagagatcagagaaagaaagtttgtaagaattcctaaaacaggatagctttctagtttctcaaatactgctttctgatttaaacaaatccaaaatacagttatagctaacgtcagagaaaggagttattaattcagctgtagaccattaaacaaacagaccccaggcttaggggcagatgggatgcttggagatgtggatgtggagagacaaaggcaatgccaagaggccagtgtgcttagagcctggcctccctggagtcctctgacagcaggtggatcccaatgaccctgtgctcctgaagggcagaaattcaattaggaactctcaactttcagctttgaggctcaggctagtgtatcagtgggtagctccactgctggaggaaaaacattctgcagcagttatgaaatagaggctaataataggacaagggagagtgaaaaacatgaggttggaaagcattggcagaaaagatgagctgataaagtatctactttaaataaggtcataattttgccacagtttggggtgttctcctgtgctaatttatagtcacaatcaaaatcacatggaagccttattttctttgacaaggttttattttcagtgcactagaaagctctttcctttctgcctgggttagcatatgtgaaagaaatagtgattattttaatgatattaaatagtagctttgatctcttccccctacaagctaaccaaaacattatctggatgtatgaaatgattcctttgtgagcaaaacctctgtatctattataatgtttttgttcatctacctgaatctcccactaggctttgagttcatctgtgcttccggaacctaccacctactcaggaaagataaactggatcaatgaaaaatacgctaaatacctaccactctcattttttagacgacaaatttgaggtgttaaaaatgagacagaaatgttaatatcaatcttctatttcaaacctactaagcccaaggcaaaagcttacaccctttctacactgcttcataattgcctaccttgtgttcatgttaaatatgcaaagaaacgttgtatccacatttgatacatgacaagaaggagactcccagagggaaggtcgcttcctcaaagacgcccaccagtaggtaggaggtctgatcgccagtctcagttctgcctgactctaaagctctcgatcctccaatcttgtcaaatttgctttattataagaatcaccaaaggccatggttataaatatagattctcaagatcttcctctgaagattctaatttaggtatcagctgggacccaataatcacgcattcattgttgagaccaatttgggaaacagtgaataagactagtgtttctcaaactctagtgagtgtatgaatcctgtggggatcaactgcagattacggtacagtggtaggtctggggtggggcctggggttctatgtttccaacaaggtcgcaagtgatgactgtgctgtgggtccacagccgcacttgaagcagtgaggaactaagccttgctgctcagctcacaataggacccttattcccaccctagaggtcctttagtaattctgccactaccacacaccctccaactctgtgcagcccagcaattatgccagagcaagctttcctgcatacccttgtaaacatgtttgtgaagcttatggaaacgtctgtttatctgtatgagttaccctgctagttcacatacctaccaaataagaatctctgggcacctgcgacacaacttcatcccatgcccatctcatccacgatggttttaaaagccaactgtttccacaggtttctattataacagggggattttatagatcacatttgctattcacaggtttagcctggacaactgatatttttcccaaacagtagaacttttaagttgggggaaaaatgttctctgcagcattcagataaatggatgaagaagcacttcttagaggttgccaatcatcacacctctgcaggacttaagttcatctaggataactcacccgaggctttaaaaaattactgatttttagctgggtgcggtggctcatgcctgtaatcccagcactttgggaggccgaggcgggcggatcacgaggtcaggagatggagaccatcctggctaacacggtaaaaccccgtctctattaaaaatacaaaaaattaaccgggcgtggtggcaggtgcctgtagtcccagctaccagggaggctgaggcaggagaatggcgtgaacctgggaggcggagcttgcagtgagctgagatcgtgccaccgcactccagcctgggcgacagagtgagactccatctcaaaaaaaaaaaaaaattactgatattttttataactaggaaagctgtaatgtgtaaacatgacaaaacgccaaaacgctaagtgaattttacaatggaacatggacttttcaaagggacgattctgattagtgaaatctgttctaaacctcggcttttctgattcctagcagggtgacccttggtaatatcttagctccagtggaccttaatttcttcattgtgaaatggcgtgattgaacataattcctaggtctcctcgaattctaaattcaggtgaagaaacagggtgatccgtcgcaatttcatctgtttcagtatatgcgtttatgacatttgtatcaaagaaaagtggagacatttcagaaacagcaagtatttcctgagaaaacatagctgttctatgtgttgaagcacaaaagataaaatgccaaattaagaagggtgtgactgtcaggggaaagacggcacacagaaaacctgttagtccttcatgccagtgcctcacagactggctatctactcacctgagcagcttttaaaaatccattctgtttcagtaggtctggggtggggatgaaattctgcatttctaacaagggtctgggttccaggggtgtcgctgaacgtgcgtctggccttatctagcaaggctttacaccggagctcttccactttagctgcagagttgaactggccagattcaacattcagatagcccgaacacatgcagagcaaacaaatttggatctctgtaagtgggactaaggcatttgtcttttaaagctgcctaagtgatttccatgggtagccctggttgagaatccctgctctactcttctgccacaggcctccactggggcttcccaggtccttgaaactttgggtttcgtttatttatgaacacatttatcacaatggtagaatacaaaataggtatttcaccctcactttaccataaccagtagagtgaaaccgactgtgccaagagatcatgctatttatctggtggggtcctttacacactcacagaattttccagaggtggtccttatgaagcagactgactttttattctgctccccaagcaccaatgctaccactaacaccgcttgtggcatatttccccatggctacatgggtctccataattgtcaccttcaagttacctgttaccatgctggtcaccatacccatgtttagtaaggttttccatggctgcatgtttacaagctttctgatcatctttcccttttccttctcatcctcactcttttcattctccctcttccttctatgcatattcattgagtacctgctctctgtctagcctatgctaggtgcttcattgcaatctgtacatggatgaagtacttatcttctactgcttctttggaattgaatactaagagtgaaattacttggtccaggaacatgaatatgttcatgactcttaacccaaatctctcttgcctgcattcggtaagcttctatttgctgattgaatatgtgtaagcttgcccctccttattatttaatgcttatgtctttgattgatgtatattttttatattctttatttggctgtaatgtgaatttaaattttacttttttctttaatagtgaatgctttaaaggcaatgagaaaccaataaagaatattaagcgatcgaataacttgctcattttatgcatgtgtcatatattttcatcttcagaagctaccagttcattctctgtataggcagggacaacaaggatgcctcgcagtaaatattctttgatttcaccagagcctcttagctttgcaaatatgagacatacatgcatcatggtcctgcaggatgagggtaagtaatctgagagaaagagagagagaggtgtatgtgtgtgtgtgcgcgtgtgtgtgtgtgtgtgtgtgtgcgcgagcgcacatgcgtgagttcatcagcctgcccgacaagggataacgtaacataatactcaagttctgggagggtagagaccaagactctaaaccgtgtccttccaaattcaaagccaacaggacttgtttgagaagagcagtgaccttattgagatcaatggcaggaagggacaccaagagcacaaaggggaaatgactaggagaccaggaaggagtcagatggtgacccaggcttaaatctaaacctagagaacagtcatggtgtgtctgtattgtcacatggtgaaagtgaatcaggctttcctggcttccctgctttgggcttttgagggtgtgtcgtataatcctgggaggctgggatttctgcaaataacgtttacaaatcaggttggattgggatttttggaggattaccacttctgtcactggtgccaccttgtggcaaatgctacagtaaaaacttgctgtagtgtaaccgatagaatttgaccatcatttcttttactaggcgtttgggctaggaagtgagaacaaatctaatatttggataaccagtgaaggggaaatcttgagctttcagtcactaaggataggtggaggttttagaactctcttaaattatttatacaggattgtttcgtttgttttttcttacttgttcagggagatctgaatagttgtaggggagagaatgaattggaggagtttctacctaaatgttaaacctcctccacactccccaacatcaacctggaaaagttacagagggaaagcattaagacatggaaaacattctgagaaactccagtgaaatacgtctgtgggagacaggaactgttgtgaacttggagtacgtgtgatttgaagcctagagcaggaggcagctcatggggctctggagctctggctctaagccagcaaagactgattcactttcaccatgtggcaatgcagaagcagctgggttgttctccaagttgtagatttaagcctggatccctgtaacttagggaaagagttgatggaattttctttctttgcttctttccttccttccttccctccattcctccctccctctcttctcttctactctcttctcttttttcttttcttttctttctttttgacagagttttgctctgttgcccaggctggagtgcggtggtgcgatcttggctcactgcaacctccacctcctgggttcaagcgattctcctgtctcagcctcccaagtagctgggattacaggtgtgtgccaccacacctggctaatttttgtattttttatagagacggggtttcatcatattggtcaggctggtctcaaactccagacctcaggtgatccacccacctcggcctcccaaagtgctgggattacaggcatgagccgccgcgcctggctgctgatggaattttctcttgcttctctccttctatggcctggtgtgctatatcactcacactagggaggctcagactataaggataagagcactagaagatctgagtagtattcgtggatggagagcagaggggacacaggtgggagctaattgggcgcaggcagccatttccccatccttctttctccaaatcctgataagtgatggactgcacccaaaggagtgtttcttcctcaggatgttccccctgggagattgaacatgaagcctggacctaagaaatggtttggtagtgttgagaggggttaactgtggcttcctggcacctgtgactctcacttcaagctcatcccatttccactctaacaccgtaggaggactgcaagtctaacgaagtctagccatggccccttttacattttcattgcctgaaaaattagccaacgcttggggggaaatgagcttcacaggcccaaataatgacagaggagcagcactatttcaaaagaacatgaattagagaaaatctttagaccaaggaaaggaaacagagacaatgatctaaagaagcgagaattgaaagagagaatactagatagatttgaaaaagataatccacagtaaaatgggtgcgataataacaatccttgctttactggactattatgaggattaaatgaattgatatatgcggtgcataggctataaagtgtttaaacatggagtataataaatattcactcttatgaaattttatattttgactcaaatgtagaatttggggaagaaggactctggtttaatatattgagtgtgaagttctaattggacattagtatctttgtatatatgtatattacatttgaagctcaatgtaaactgggccagaagtataaaaccagtggtttggcataaactgtctctgacattgtaggagaaaacttcaagtggaatggaagccttaacagtgatgtttgtagggcataaaaaaaaaggtttcctgaagaaaggtaggcagattcaacaaaatgaacaatccaaaaaaaaaaaaaaagaaaaaaaggaaaaacaaaaaagccacaaattcaactacttttataatattctcaaatgcaattttataatattcaatattaaattgtgtgaaataggagagcaaaagttttgttgccattcctcaatcctcctcaccaaggtttaaccacagtttgttggatatttaccctcagttctttttttatgtctaaaaaaaagacatgttttactcagtgtacatgtggagctttttacttatggcttcagggatctaactcatttcttaaaatgactatgttgcattccaaggatgaaaatacacactatttctaactatttttctatagacaagcagatcagattttttttgcaattaacgctgtagtaaaacttttaaaaatacgtattactcttgagttattggaacttattcacaaaaaaggtaattaagttccagttaaccagtatgtatagattctataatctgcccagaaacatgctaagtactgtatataaagcatcattgtgaaagataaaggcagtgagtattttaagaagaaggagtgattagcaatgtcaaacgcagcaatccagtagaaatacccatggatttagcaagaagtcaattgagataaaaataagagctatttgaattgtactatgtagtaagatggcagatttcaattagttaaggtgtcattagagatgggaaagtatagaaatgagtacagattaacactgaaacaaattatcttcatatacctatttgacgggaaaaacatatttttgagggattctagtagaagtgtacattggtataacaactttggaaaacagtttgttattaccaccagtcacattgcacatgtacctacactgtaactaatcacttcctctcccagagaaattcttaatattaacactccagaagacatggacaagaattcctagaataaattttgtaataacccctaatggaaacagccagattttcattaatagtagaatggcagcggattacattcatacaatggaatgccatccagcaatgctaatacctacaggtaaccacatggatgaaccacagaggtataatattaaatgcaaaaagcaagatttgtaagaagatgcagtatgatttctgttagacaaagttaaaaggcaagcagacaaaatggaatattgtaaaataataaatagcagcaagggaaccgtcatcaaaaaaggcaggttaatagttggtgttttgggggaaggaagaagattccatcaattaaagatgcatagagggctcctgaatccagcatgtttcattttctgacacagcggtttttgtatgtaatggtgatgttaatgatgataatgattaaagatcttctttaagaatggaatatgttgtaatggaaaacgacaacattacagagataacaataactaacatctattgatccttttgtattctggacactattctgaatgcttatttaatccttataaaaatcctttaagataaacatagctatcataccccattttatagtagaagaagctgagatacaaagcagttaagtaactcgtccaagcggcagagcaagaaggcgatcagcctccagagcttagattctcaacaacgtgtacaagattacctctgaaagactgaaaagctatttcatttgtgctttgatttttatatctaggtaactttgtagtcaatattttactctatttgtgagatttatatcttaataaacttttctcatattttattttatcacttatgcttcatgggttgggagactttatcacactaaatgagacacctttgagagtaagatgctataaacaatactcttggaaaacaagcataagctgggactgtcctggacaaactggaacacatggtcacctttcatagcaagaaggtgataatgcagcaaggccactactgatgaattctttcctttcttgtgttaacgtgttgcttatcacgtgagtttttgtatgtgtgtgtacttatgaacattctctttagtttggtttaaaccatatttgctcttttatgccatttcatattgctttaattaactttacttttaggagattttaattcctagcagtataagttctttttcttcactgttacactttatccaaatataatttgataatttaaaaatttttaaaaacatattttcctgttttataattgttttatttgtattacctttatagaaatacaattttattatgtttatagagtgcacatggaaaagaaaaatttgcagcccatgggatcattactattaattgctttgccttccagtcttggccagaaatattcatctttataatatttcattttatccttctcatatgtagtatttctgtgcatttattcaaatgtttttataatacttcctttagtagcttataggtttttatggactcattcaaatcccttaataattattttatcaggaatcttctcattgcttaactagtatgtgataactagttaagcacaaatttgtgttttataatgataaaggaaaggcacaaatttttgtatttttatttatatctagttaccttatgtactaaacatttttgttaggtagattttgaattgtctgccttttgcaggcctgtaatcctgcaatataaaaatagtgcatctttgtttcatagacttttgttaattttttaaaaatccagttctcacatactattttattgatccagcagtcgaaaccgatattaaatatgttaaagcttattaaaggtcccattattgtatataagactgtaaagtagttatctgtacattttatacataatgcatatgtataaatatattttaggcatagacataaatttctgcatagtcctttttatcaaaacccattcaatggagtactttattctcattaagctattcatatggtgtattaaactaatagttttgcctgtatagaaatattcttgaattcataggatgaatttaatcctactgcttaattgcaacctctaataatgtacttaagactttaatttaatattcattagtgagattggcctggcctaattcttattaaagctttattacattagatatcagttggcttttatttcacggaataccttcaaaaaggccttcatttattcattacatattctggcaatttgtgtaacactggtattaaagtttgtttatattttaaatgaattttccaataaatgaatccaccatatttgttttcggtagggtaattttttgacagcttcccaattctcatctctgctaacatttttcttttctataattcaggactgcattgtacatttatgtaatttttttcataaaatcaaaatttgtttatatcttctctctcttaaatgtttaagattttctgtccccaaatgagtgcatttagtaggctgttgcacatactatcagaaattccatgaattcatacctaaatttatttacttatttaaacaatttatgtttttccttttttaaaaaaaacacattttctttagcattgactcatttttgtgtaatttttggttaaattaggttacatgttttgtttgcttttacatttttaataatgaaagtacttaacaccatgattgtttttgctgagtgtgtataattgcttagttggttgttttaatagaattgttactatgtttttatttattttctccttcactcaattgttatttggtaaagagattaaaaatataaaagaggggattactatttaaatttttatctcaaagtttatgttacagtaatctgacattgtgatctgtaagcatagagactgcatttatacatctctacagctaaatttactgattttagaatgaggaagaattttcacaatggttaaataaatgataatttttctaaatgttttattaaaaactcaatgttcacagatacaaaattcaaactcttactatttaattatcctggttaaatatgtttctcattcttttatgtctttttatttttatcaagtggatgtgtttatgataatttatcttctcctatacttaaatattttaaaaacaattttactgcatcactaaacattaatctgctattcctttcaaatgaaacctttttgacagataattttgaatataattttatcactttttaaactgtcattattaattcacttaataccttaataccattatattaatattgacaaacttatttaattttattcacatttgagtcatctgatttttttctccatttgaaaaatgtctttaagttgtttgggtttttctttttctctaaatgcaaaacttgaaactataaaactttattttagtttttttttattttcaacttttattgtaaattcagaggtacatgtgcaggatgttacataggtaaaaatgttacatatgtaaaaatgtgccatggtggtttgctgcacagatcatcccgtcacccagaatccattagctattcttcctgatcctcttgatcctcccaacccccaccctctgacaggcccaagtgtgtgttattcccctcatgtgtccatgtgttattatcatttagttcccacttataagttagaatatgcagtatttggttttctgtttctgcattcgtctgctaagggtaatggcctccagttgcacacatgtccctgcagagaaaatgatctcattcctttttatggctgtatagtattccatggtgtatatgtgccacattttctttatatagtctatcattgatggtcatttaggttgattccatgtgtttgttattgtgagtagtgatgccatgaaaatacacatgcttgtgtctttataatagaaagatttatattcctttgggtatatacccagtaatgggattgtgggttgaatgatatttctgcctctaggtctttgaggaattgccatactgtcttccacaatggttgaactaatttacactcccaccaacagtgtaaaaacattaatttttctccacaacctcgccaacatctgttgttttttgccttcttaataaaaccattctccagcatctgttgtttttgcctttttaataaaaccattctaactggtatgaaatggtatctcattgtgatttgatttgcatttctttaatgatcagtgatgttgagctttttatttatgtttgttggccacatgtatgtcttcttttgcgaaatgtctgttcatgtcctttgcccacattttaaaggggttatttttttcttgctaatttgttaagttttttatagatattgtacgttagatctttgtcacatgcatactttgcaaagttttctcccgttctgtttctgtaggttgtttgtttacattgttgatagcttcttttgctgtgcagaagctctttagttttttcattatatatttagatttattgactgtatttattatacctattttcttctcagacaatcaagaataacaataatagctacaaagttctcttggaggaaagatataaaaaatacttcttgagcaaatattgtgccattaatatgcaaagtgtatagaatgatattcactggtaggcaggtctcaaatggtgtggagcaagcaccttttccaaaacatttctcatggtttttcttcttcactgagattgaattagattaagcgtaattaaaaatggagagactctatacaaggaataaggagggcaatattttataggtaagtatgcgagagtatatgaaattggggatttttgctataaagaggggattgttgctatagacagtaaattgatatgattttagatacaattataggatacaaattttgtttacaaatatttagtaaggtgtgtttataaaatgggttgtcctgctgaaaattgtaaaggggcaagaggtatagtgaaaaagaaaaataaaggcaaaagccaagcataatgttttagctattaaaccacatttctgcttttcatgttgtcttaaagtgagcatatattcattcttgcaattaggagtatttgattgtaaaactgctaaatacaaaaaaataaaacagataaatatagagtaatgctagcaagtagtaattcagttgaaggaaaaaaaatcacatcagtgaaatcacttttccatgaggcttttccatcaaatataaatttttatatagtttaagcacatttgtttacttttattcctcattattctaccctctctggtctagaataagtctaacatgggcatttttaaaaggccatacatatttaaacgaaaatgaaaagattaataactgtgcaagtattgaaactttaattatataaattctcaggcatgaaagtgttctttggcatttggctgtatgtaccattacttgtaatatggctccttattaaaagtcttttttatgcaagaagataaataatacaaacatcaacaatagagtggcatgggtttatttagatattaaactgttaattatgtatttgtcaaaaatcataaatcaggacaagttgagctggagaatgaaatattcagcctaggtctcattgtcatcataaattcctaattttggtttaaattaaggtatggacaagagtcttcatagaaacattttcaactcttctcttcttattcctttctcattttctctaaagaaatcttatcgaacatttaatctcaaaggtcatgaaaaagtatgattgacccatattgaagatatttttactactttcctttatactcggaaagatccactttttcagagacacattaaaaataactacccactaatatgtcttatcaaattacttcttggaggctgttattctaaacacaggagttagttcagtcttggcaggttttctttttctcttctttttatttatttatttatttatttttgagatggaggcctgctctgtcgcccaggctggagtgcagtggcatgatctcagctcactgcaacctcctcctcccgggttcaagctattctcctgcctcagcctctggagtagctgggtttacaggcacacagtaacacgcccagctaatttttgtatttttagtagatatgggatctcaccatgttggccaggttggtctcgaactcctgacttcaagtgatctgcccgccttggcctcacaaagtgctgggattataggcgtaagccaccgcacccagccttgacaggcttttccaatacaccatgtcatatttcatttttgccaattatgttacatgctttagctttattttatttttttctttttcttatggaaaatggaaacagaactgcttttacttttaaacttatattggcttgttttaactcctcttatgttttatcataaaacactcaaaatatatatgcttttaattccaatccgctcattgtcttaaattgtattttcaaggaaagaatggaatgcacacaactgctttgattgtcatttctatttccagttactcatgtaatggcactgccaggctggttggttggcattgtcttaggtgacgcatggaccatttcccctgtcttccagctgtgggcgttataacattcttgtttttcagaatgccagtgaatgtaccctaacaaacaagaaaaggaaagactgaccaaatctgaacattttttagctggaaaacatgtaaatttaatacttttaatagatgaaccctcatgttagcatgcaaattagctgttcctaccaagtcaattggaatgtgacagttaattctatacatgcatcagcaatgacctcagaattggctgtccatcaacttccatggctatgaactcacccaccatctttgttctagaaagactttccattaaaaatgtaagttcatgattaaatcaaaataagataaggggattattttaacattaatataacaccagaaattacatttgtttctgtggaggaatgctctgtttgctttggaaagaatgcagatccttttcatttatacagagataatatatatttttaacctgtcagaatggcaaagaacaaagttggatagcatgttgttgatgagcaggtgggagcatacatatatgtataagtataaattgctacaatgaagggcaatctgtttctaaattagaaaagtactgatcctgtgacccagaaatttcatttctaagattagatcttacatatatcctagtatcataaaaatgattccacaacacaattactcatcacttcactgaaacaacaaaatattggcaacaattgctcatcaacaagagattcattaaaaaacattatgggactctcatgtgggatataataatgtgctgtaaaaagggaataagaaagtttttttatgaacaaatgtggacccatttgctgagattattttaaatcaaaggaaaccaaggtaaaatgtaactatttacgtaaaaagagaatgtatttgcttgtgtatggattttatatatgaatgatatctctaaaattacatctgagaaactagaagtattggtgactagtggagaaggaaaataggtggctgtgatcaagatgtgagacaggtaatttgctatagaaccctggatttccctttaaaaataataaaattaatttaagatcatgtaatatggtaaatatttggactgctgatacttctttaaaaatcagtaaactttgaattgtgtacatttataacaaacatcctggcctctaaatatgtgaagaagtgcagaaatcatatcagtggtaaaaaaggaattagtacaagatttcatcttagagcatccagactctaaattgatagatatgtaagaatgaaagtttatttaaagtggaataatgtatacctcttcctgtgtccccaagatggcatcatctttctaacattgattcagcttgggcttgagtgtctgagctgtgtctcacaaactaagctctccataccatcggcatcaaagtcatttgctggagtgtgttaaaataaatattttcgaattctatcccatacctgccgagtcagtgggccttggaaaggagcccgggaatctgcattttacaaaagatcctcaggttagtcttaaaccaagattctagaaccactgttgtaaagcctggggaatagagaggagaaaatactagaactactcattaactggttagcacatgatggcatcttcttacaaacctttgtgtgcattcacccccctaaccacaaagcaaaatgagcatcagaaccttcatttaaagacaggaaaattaagtatttgtctttgtgtaattaagtgacttgccacaggtgacagagcgagagaatgcaaatcagaattcaactcgcaaatttctgctttgtccatgctgacaggaatagcatcattgtaaataaaaatcactgtgttagtgtaactttgaaaagtcaatccctcagtaaaccttgctctgcagtggaaggtcatgcctttctcagcctttcactacctaggattcacaggagatcaaatactttgctaaaaagagattttcttattttacttcacattctcatatctttatgcattactctcatttattcttcagagaacattctgctcagattaacttctgtaagcaacaagtatcccacatatattttcaacggccagctagctattcttaacaggaagaaaaaaatacaaacattggtgtgtactttttatatggcagtagacaaacgagggtaactggtgaatatataagttaatattctgaattaataaaatgaagacacattttgaaatcaacattacaggtaatatccaataaatagctttatacatatacacacactcatacatgtatatatgggtagtttctggacttaaaatagattcaaaaaagtttccattatgtaccagaacaatagctggtcttagggagatgagaacacatgtagagtctgactttatgaagtcattgacattaacacgtatgataactctcaattgtgaaagttaattctgtcagaaatgctgtgtgacaggcctattagagcggctacttgggccatttattgtactgtggcctatttccgacaagtcagataaaccatggtttgaatctccactcagtcaaaactgcagctagtcacttaaccacactggtgttcaatttactgtctgtgtagtgaattgaacatacctacctcaatgcgtttttatgggaataaaacaagagtacaaacctatctgtccactagtggtattttttaccttaagtcacattccttcaccactaatagtggttaagttttctgactctcagtgatccattttcaaaaggccatctctgaaatttttgcctctactttctttaatggcatttccctatgtcactgcttaggtgatatgatttaggggaaagccatattttacttgagttaaagtcaagtttgtttgtgtttttttgtgggggggctggggtggattgttctcaaaatgatttactgacattctccagcataagttttaggtgaaagagtattctcaggtgggaaatttgagtaaatcttgaggaagaagtatattctttacaaatcatttagggaaaattctctttaaatagggggacctacttatgcatctgatttgcccgtgacactcattgtttacactttcacacctacataattattaataatgctcttttactttcaaaaatgtgtagtttgaataaggtgtatgaaccacctaattgaagaaagttacttgtcttaacctagaggttagctagctagcatcaagagtttaggggaccaaaaatggtaactctctaggaaataaaaagaggaattcatctacttctctgcagaagaggactggtaaatggactaactttgcattcaggttgtaattagacaaaacagaaagtgtgatcaataatgcaagtgcatagtggcagaagagagcatggtgaagtgagcctgtagacacacttgtgcaatatggggacagctctgatgtggcctgggctgtggaattcagtttagggggaagtgggttgggagtagtggtaaagatgaagtgagtggattgggccctggcttccggattacaaatgtacttttggaaaaacaagattttgaatagtgtgggtgtctatgtaattactaaacaaggacattttttagcttttggctcaagtgacaaagattttcctttcaaaagcattttgccagattgaaatctaaacataaacgtatgacaacattgctaccggtagctaattcagtgattcaacatgtctgtttatcaaacacttgagagcactttcaaagagccctggtttgggtatgaggtagagttttgtgaggcttcttttaaagcctctctgtctgagaaggaatatgctacttttcataccaccttgccagaaaggaaggcccagaacagaaagaacacaaaagaggtataaggggttaagggaacctggaaaaacctttgaaaagtaaattatcagtttagaaatgctctttaaatgtcaacaaagagtcagcaggcagtgtgtcagctctgcacctggccacatttcctatcctctgttgcaacttagtgaagctacgtggccaaactagagccaacggaacataagtgggagtgatatatgtaatttgggggcattttccacataaaataaaagctctttgccatggaatccctttgtctttccccttcccatgtgtggtcacaggaatgactatgacccaccttccaatcatgcagatgaggataatgcccaaggggataaacttttggggaaaaaatgagtccactcaccaatccatatttaaagacttatatgtgtggaagaaataagcttttgtgtgttttttagtcactctccttcagtctctatactacagcagttgaaatagaccttacataatacacaccctttctaggtacctacaggtcttctgcaaaagcagccatacaatcttcagattgtgaccaagttgcttttaaaattctcatccaggttgcctcttttttctctctcttggttgtagcaattctcatcagtagtgctgccaaagttgaatcctctttcgagcacatgcaaaaaaaaaaaaaaaaacaaaaaaaaaacccacgaaactaggaaaagcattagaattgccccatgtgaattccactcacatttcaaagccaatacatgtaaaagattaaatgaaaatatcccatctactgttatcacactctgctgtcttcaccaatgtgaactgagaataagagatggcagcttttcaatgtattgcctagattcctctggcttgtagtgctcccgtcatttctatttcctaccatgcttctgtgataaagcgagaaataatatgccaaaatgccactagcattcaatacagggtatgctgtcctctacaattagcatatttttttctgatagaccaagtgtttaggatgcaatgatttataggtccaggaaatatatagacagttgcttggatgaaagaagggtatgtaggaagttgactttgtgtactaataaatgccaaaaggtacattaggttaaggaaattatgtatgaaggagtctggcgataaattactgttgcatttttctgagttgaattgcttatgtgtctgtataaattgctaagcagaaaataggctaagagcattaaaactttagttaactcttatttcctcaggtctatgtaattttaaacttatttaggacaatagcccatttgttttacaaatcacagtgttcattgcaatatctttcaagctgaaagcactaaatcactttatattatggagacctggaagaatgcagcattatagcttggctggcagaacatgtatcagtgagatattgatctaaccaggaaaaagaaaagctgtgctgaatggactccacactgcaaggagtgttatctgcaggctgcagtgtttgttcaaatcccatattgctggaggtgaggtcatatatatatatatatatattttttgcaggcttcatatgattttagtgacagttatggccattttcttaatctgaaagattaagaaagttgtttgttgaagaatgtctgtagataattccttgacatcaggagtagctcacctttctgcaggaatgggttaaaatggaatgttgatcaaatgctctgacttcttaagtatggtttgtctatacttccaaacctgtatcacagaacccctctggaccctttggcaattcaaagtatcaacactgagacaaaggtgtagctgtcagtcggaggggatattgtgtagttgccttaagtagtgttttcctagaagacccctcagaagtaaagaaactgaaacagaagtaagacatgagtcttaattggattatgctgagattaggatactgtgtggctctgacttctcatctcactttcaaagaccgaggagacaggtgcatccgtaatttgcatggggtccaggaaggagccctgtgggaaagactcagctctgtgtacagttagcattaggctgttccaatatgactgattgacatggactgactgacagaaaggattaaagtcctggaaagagaacaacagaagtcattgccaggagggaatgaaatactgtaaggaagttaggaatctgccatgctgaggataaggaaatagagagctgtgtttgaacccatcttcattttgtcccttaggaatgcatgtgctatctggaaggataaactagaataatcatatcaccagaaacataagtgagtcagctgttcgattcactcctactaccaagagtagacctctagaggagcagcatatgcatggcaactagacctctgctcctggcgtagatgtgggcccctggtcagttttcataagtgcttattaaaagaataatggaatggtcatcagcaagctcctgttagggatccacttactgtcctgctggtacctgtgcactctatgataattcatatttggaactgttttattccctttattgtatgcagagggtattttgtgtggtcagagattcttccatgtgcctgccaagtgattattcacctttttattccaatatcctatgtataattgcacctacacactcccatacaaatcctaatgcagtgtataggctgtgtattgctatttagtatgctttgtctccagttgtgtctctgagcccaggtccccctccataacatcacactgtgctatttctccaacatgctggcagacacagagctaacaggaagcctaaacagagcatttccctttgggttgagcgtgagggggcttcttcttcctctctcatgtcacactctgcttggcatgctctccagtcctctaaggaacagatgcaggagcacatttacaaagcaggactacgatgagcgggcacccgcgaggcttgagatgtgcccagcctcctccctaggcaggctgccaaagcaaagctccctcatgtaatagcttgggcagataatgggtagacacaggaggaacaaatcaggaagcaaactcactgtgggcctgattcccatttagagggtgagacatccacagtctgggatagtgagaaatttatggaatgggctcttttttccatttctactctcttctttgctgtggttcctcaaacaccacttggtgcacagagctagggaaaagcaacagagcttctgaaatggcatttggctaaaacacccagccaatcttctatttttatttaattttcatatcagcagtattttattaaaaccattagtaaaatacagagaatatctaattttagaatgacagcattcaaaccatccgttacaaattgattttaattaatgtggtttgtcataattaataggttattttgactctccacagtagccttcatagtggtagatgaggacctgaggtcctctctcccacagctttgcaactgccaggtgttacattacaatggaagtaagtcttagcttgaactcttctgtgctgctgtggaatgaattatcggtctcaattcatcccttcccagtagtattaagcacaacctagccatgcttcatagtgggtccacaatttccccactttttgatttggggttcagatgtgtaacttgctttggtcaatggggagtctgcagataattggaagtagaggcctgaaatgggctcatgaattggaattgctttctcagtttctgtcaccaccatgagaagaacgtatgccagatagctgctgccaattcattgaaatgagaccctcaaagtacaacgcgtaaatgcaagatcagctgaaattcagctagcccacaattccctaagtcatgggaaatatggtgtaggtcactgatatatcaagcttgttgcacgttattgtggtaatagttaattgacgtacatatataccaacacataccagcaagtaagcacacagaaaattatacaaccaattctttcaggcactccaccaagcacattgcagatgtgaaaatatgatcagggcaggattctgctcacctgattgaaattcagggatagatccctcccttagtagactgtccatatgtcaggtacacacagctgggataatacctttatcctagttgtgtaaaaccagaataaataatatggacttatagtttatctgatctaggccgaagtcttttaaagtaaattatagacaatatggcattatatatctgtctatcttatcatctactcatccttccatcattcatccatccatctatccatttatccatccatccatcatccatccattcatcatccatccactcatccacccatccatccatctatccacccattcatccacttatgaatccaggcactgttgctttccacagtcatgtgggaatgtaaacatgaccaattaaagctgagtcagtgcaatgtgattttaataataaataggagaaattattattgccccatgacctttaaacatttttgtcaaaacattgaaaatgctcttaccattagatatagagaaataaaaaaatagaaagactaatatttatttagtaaaatgtaatttaagatactagaaacattaagaatttaagtattttatttctttattaaaatcttatcaggagcggtttgaacagggcttggctttttctcatggttatgtaatctgtagtatggagggaatgagttttttaagccttggcaaattgccatactcctttcaaagactggatgagtttccaatatcttatccttttgagattttcatggtgtgaaatatccccaagagttttcttaatgtgaagatttttttgctgtcctccctcgctgcctctggaacattttttttcatccttcttgtcactaccactttccatatttatatcaataactttccctttactaagttcctctagctgcataatggaagctcccaaatggcagaagtgccaatatttccaaggtcacctagtgctcctataatttcatttacatttaattcaaattccacttccagatttattactctttgtttctttgttgttctttcatctttattgaccagttccctttttcaattgtccatttgataaatgagtttatccctgggggaaaagggggcaacacagctacacacttgccgtctactcatgaacaaatatatgcacagcaaccaatcgctgactgacttagaaagaagtgatgtgattggtcattggtcatgaatctgttatttacatagtgatttgttgactgaagagctagcaaagaagtttgtagcttatgtaattacttgcaattaaggtaatggagtaacttaaatttgaactgtgttgttgggtgactggtgttatttaattaaactgtgctcagtgaggactgaccatatttatttgtccctctctcactctgtgtgtgtgtgtgtgcatgtggttaaactatggatttctaagtcttttttcctataaaggtaatagcaatgctttatagctgctggatatggtcacttaaagaatttgctatcaaccccttagaatctgttatcaaccctttagaatctgtagtctctgtttccaaatcacaggctctgtaacttttctcattcttgtctttctgtgagtctccaatgtcaggagaactgcctctcctgtgagctttgtgccttcctgttgtgtctgtcatccttctccccagcatggggcaattggtgtccctctgggagttttcagatagtaatttgcccatcttggaaggaaatggtctccctttggcctccttacttttctcagggtgtctgttctcttcttgcaaatgtctagactcctaagactattgcctccacagcctggaacttttaatgctaatattgtataatctggtttgccagacctcatgcctggtttagaatgctcatcgggaagaaaaaggtgctcccaaattatgtggataatcttgaagttgaattattatttagaatacaaaatgtatacattgaaaagcaaactcatcttgtaaggaaaggaaacatttgcatttcatagtgagaacatggtttgtctaagcaagaaataaaattaaacatagtgagccaattaggaagaaatgatctgaatatgtatcattgtgacaatattaactcatgacaatttctgcttgtcccattcagtatcttttagacatttctaatctagagtcagtgcaaaagccactggccagcttctaaatgccagggttttaaatgcctgtcaaaaatgaatttgttaccttattttttacaaggacactttgtaatgcaaaagggcaaaataccatactctcccaggaaatatgtggtaaggaggctaaaccaatatttttctttttaagatagataacatccctcttcacaaagagaaaagagtaactgttgtctcctctaaactatctttcagacgtttaatgagagccatcttatcccagcgagtaaaaggcaaataccagctgcctcctgagagaggggcaaagaaaggtcaaggaagacctcctgctgctggctttgggggcatctgctgtttttctcacccacaaagggcagtctgtctttgagcacttacagtgtatgcaaggagagtagcccagttctgacctgtcaatcactaggttagactctctctgaaactctcctttaggcaatggcatctaatctatgcaacagtcagagtgccagacacccagggcttgggctaggcttgcagggctcgctggagtggcccttggatcttagaactaacagaatcaagggaagtgggaaagccaaggccagactcagcagcagtagtcctgtgaaagagctagactatggggagagaaaccaaataggagctaacaggtcagctgtggacagcaagagaaagagagaggttttggaatgaagggaagtgattacaatctaggaaggttactgaaaacccagggcttgtttttcaataccttttgttaggtcaatatagcctctcccaaattttaaaaggagttttgaagagggctaagctaatttgaacaagtgagatcaaacaactttggttccaactgggatcttctagtcatcttggcttcgtgtatgtgtgtgtgtgtgtgtgtgtgtgtgtgtgtgtgtgagagagagagagagagagtatgagtgtgtgcctggcaacggtgaaatcagtaagaggttaacaagttcttttgtttccccagttgaatttaggcatagtaagtaaacaaaccgacattttaacatgtgcttcagaaaacgggaaaggtaaaagtcacttccaaaaggcccaagaaatgtgcacatttatagcaaagcaagggtgagtggaatttgagtacataatatagagaagcaaacctatggtagtaccaaaaattccgccagtgatcattcctgggcttcaggacctgccatgatgccctggaaatgaggcagaaggaatcagcttgagctgcttttccgacttgatgaaggcattcctcctactgcaagtttctcacccccacttaagtacagaaggaagcaggatacaccaattgcttagagtatttccaaaggatttaatgcaagactgtattgaaatatgctttaacaacttctacaatttctgagactatgacaagtgatagttaattttgacattgctgactgtggctgccatttattcttagcacagttattcattgtactatctggaatacatgcctcctttttagttaaattagaatcatgataattaacaaatatttttcattgaaaaagtacattcacctaataagcaaagaaacataaaagaccaaaatgactactgctatgatgaaagacaggataatttttttatttgttctagacgtaccaaatagaagggaattacaccaactcaaacccagggcacatgtaaataaataaaagtataatacaaaatatctttcttaagatgtcagaagaaaatttagctattctgaaactcaacagcagaaactgttgtatttcccatactaggagtatcaataggcaagtgtcttagttcgagctgctatctcagaatattatgcattgggtagttgatgaacaatagaaatttatttctcacagttctggagagtggatccctgagatcagggtgcctacatggcctggttctggtgagggtcctcctccaggttgcagactgccaacttctagttgtgtcttcactgggcagaaagataaatgtctaaatcccttcctcttcttaaaaagacactaatcctatcatagggggtttacccacaaaagcttcgcctcttagtaccatctaattgggggttagagtttcaacatattaattttgaggggacacaaatatgcaatctataacagcaaggcattgagagtggagatttatatgagccaaagcagaatcacagacaaatcatcaacatggttgttggcacataggcatttgctaattgtttcctttatttaatttagcatttggaaatatataaatttatctacagaaataggattatggaggcatctaaaactcctctgttgtacttctatgccattcaacaaatacctgctctctgaaagccttcaaattgatgtctgcccttaagggagatgaatgggagaagataactagcagtgagcaaacactatatctgatcgtttacagatattaaataatttaatcgctagaaaaagaaagcaaagcatagataacatatataattatcccacttttagagatgcagttcagagaatttaagtgataaaattatctagtaataaacagcattgtcagtaatgttagtaataaaatctgaaaatactaccacttatcaaccacacaccacgcagaaggacctgggctaagcactagatgtatattttatcctctcagcatccctgggtgttggctactgttatttaaattgcataggtgagaatatgaatggttcctaagaactgtgcttctcaaaattttatctacatacaaataaactactgatcttgttaaaatgcagcttcagattcactaggtctaggtagaacctgaggttctctgtttttaacaagcttcagatgacacacatgctgctgatccatggatcaaacagaaaagctggggttgagaggtgaagtaactcggtcaagtacatgaggcagattctttttttttttttttgagacagagtcttgctctgttgcccagtctggagtgcagtggtgtgatcataattcactgcaacctcaaactcctgggctcaggtgattctccctcctcagcctcctgagtagctaggacaataggcatgcaccaccacacctggctaattttttttaattttatttttaatagagatgaggtcttgctatgttgcccaagctggcctgaaactgctgagctcaagccatcctgctgcctcaggctgccaaagtactggaattaaccagcatgagccaccatgcctggcccagattgactctcagtggagaaaagatcaaactgttatttgtttagttcaaaattgcaagtgcatcttgccaccctgtgctatctcttccttgggtttggcaattcagcttagtggggagaatgagatgtgcacaaggatgactatgagactcagtactaatggcaacacactctcagacagaggcaaagaattccaccaccgtctctgccactcagggcttcctggaatgcagaatatctatgagtaattccaaatggataaatgaggatgattcccaaaaagaggtgtctggtaagctaaacctagaagactgaagaagattttacacataaacacataagaatgtatatgtgcatgtatttatatatgttatattgtatacatatgcaatataaatctataatatacaaaatttatacatacacatgtatatgggtgtgtagctatatataatgtatgtatataaattatatgtatatatgaatatgtatgtgtatattcacacacacattatatatagacacacacatatacatatattttgatatctatcttttgcttctagatagagagaagtatgcacagattctatacagtatgaggcaggatcacaggacagcttggtattttgaatgtactttgattccacagatcatgtagatcacacagtattttctcttcccttctcttacatgaggggcacccggatataggacacttagagtagcttattgatttgcttctctacttgttagtaaaatttttaataataggggctatggaattcttgatcttagaatacctagggccctagatcttgtcaattcacaaaaataattcatttgaattatttgatgttcttatttcagttttatttgaattaaattgcttttgatatttgcctttagtaattcaacctcattttcttaagatttataaagtttttatttggcattaatttggaaaatcagatatcgtaattaatttaaagtcatagaaaataaaaatatgagagcacctagaagtttgtaagatgatgttctattgctttattggctttactcagttatttaaaacaaagtttatatgcaataaaattagtataaaatccaactgatattgagaaatatcaacagtaattaatcaaattaggtttctatgataaaacctcattattaaatttgattttatttatgttgacattttctaagaaacatctttagaaagaaagcatttgaaatcttctgattataaatatttagcctcttatgttatcataagaggcatatctattttaaagaagccactgagaagctgtacattaattaagaatactatttattaagaataaatagtcatagaaataagggtgctggtagttatgattccccaaatagaatgtcacttctgttaaccacaatattcagccatgaaccttctgaaatttcaggccaagaagaaaataaagtcatgtctatagctgtgcctagttagtaatcagaaggttgagtttgggggaaaaaacaagcttttctccttttctaaccaaagaagttgtttttatttggtgtttgtttatttattttcagctgttgctcaagcaggttcctcaggtacagactgacccacacagtataacaggccagatggtacgactttagaactttaagtcatatttactatgtgagaatttttttactcatttatttccttcttcatctttccagggacagcctgtgaattgtgcagtgaattctttcagtatcactaacctgaatctttttataatatcctcttttacctaaattttaaaagaaatcaataaaacttttagttattatttggcattcagaattagattcaaatacgtctatgtgggtgcctgtgcgtgtgtgagtgtgtgtacctgctggtaaagacactgaagacatcattccagcaaaaattgatcactgtgtttttggatttggtcccaagttattttctgtgagatcctctttctcatttttgcttttgattttgacagaaatgacagctgaaatgtatctcaataattgagtttttaactttttttaaaaagatagcttactcaaagcaactgttgttcatagctgttgtaatttaaaggaatctatgtgatctttgcaaaaataactttcctaggatgaggtcaagaatgagtaatgtacaaccacagaaaagacgtgacatgccttcttgtctgaaacacgtgaagacacaaggaagccttcatgctaggtaattatttccagaggagcttccatgggacttcataaaagcattgacttaatgatgaaatattgactctattttctcagtgaacactctattcatttgagcatcccatcattcaaaccttgtaaatcctttcacagtcttcgggaatagggtccagattgtcatccgcatcttgtcttcagcagcaaaaaaatacacactcctcccccactcagagaaactgccctttagccaacattttgtgtcatttaattatttgcaagattcattaattggcaacagcccttccagattttccttagaattaacaatattccactataatttatagattatgtgtcactcttcttcctcagcttgaaaagggcatacatatttcaaaatcacttttgaatcttgaaatttaaacattttccccaatgacatctattttaatgcacatgatttaaaacatgagcttttgatataaaataaagatagtttgaaagaaaaatagcagcctctaagttttcatatggttcttcctcctggggatatttctagaattgaaaacacttaagagggtgcagaattctttgtcgagtgcttgcttttgcttatttagaaatagagggacaatggcagagaggggtatgaactctcctttatcagacctgccttctgggctcatttctatatcttatcaataatatgactttggacatacaattccaaatctctaggtcgtagttttcccatctgtaaaatgggaaaaccctcaacctcaacaaattttttggggggttaaaagtgaactaatatatgaaaaacaattttgtatgccctgaattatttatggaattttgtaacttgaggtttgctgacctaagttgtgaggttaaaggtttagatattggaattatactaacttctaggctgaaagtgagctctgccattcatgctcaagactgtttgctttctgacattttaggtttttattctttccaagtatttatcacaattagggagaaggcattcaaaccttagtataaatggttaatctgaatacagactaggaagacttgggtcattcaaattcacaaacctgtgtaagactgcattgctcaccccttcgggatggtttttcttggtactcattggactgcaaagggtagcacggtactgtgccaccccaagacgaccttagtaagaagcctgggtaggatgcagctgttcaggggctagtgtctgctgggactatgaggttctaatttaacctcacctaatgtctcacttctattattatccaattttacagccagtccatgtgaggcacagccttgccaaagttacatgactaaatagagaagctgcgatttagaaccacattttctcactccaaatcttgctatctcaatcattatattgtaccttatttgctgaatgaatgattgaatgaatgaatgaaggatgaatgggtaataaatagagagacattttactacataaaagctttcctaagttatgggaaaatatttctgagatagttatttctgtatatttgctaagggattagtaattttcaaagttaggatgccacatgtcataactggagtctattacagttaatcttatggggtctgagttaatgcgctataatgaacatggttgtaaacagaaaggacacccatttttgcattaaatgccattagctggtctgagagcaccttgagattatgacatactcctcattttgccatttttttccctgtcagcatggagcacaggttctggtagagcgagagtgctttacaaagacttgctgaggatgagtggattaaatctttcactcatccaaccgcttaagtccctgctgcactgagttaggagctgggtctagagtggtgagagaatgatccacaatttctgttctgatgaatatttggaacaaatgaaggagtgctccaaaggaaattgggatggtgtgtggttgaggacaatgagggtactaaacaaagtgaaaaagacctcagaaaagtggtcgaacgaggcctctcttggcaagtcacatattatattagatatgtgaaggtgatgtttgaaggaagagagtgaattagaaggatgtgtgcataccaggggcaagcgcatctaagggagagcagcccttgcaaagaccctgtgctgagagtggcatgctttgcctgagaacctcaagaatggccatggtggctggaacaaagtgagtgaagggtagagtaggaagagatcacgtgttaatggcatgacagagattgttcatgaaagtaccttttctatctttggaatgatctcagtagtttgttttttttttttttgaaatggagtctcgctctgtagcccaggctggagtgtgcagtggcatgatcttggctcactgcaacctccccctcctgggttcaagtgattctcatgcctcaacctcctgatgcacacctgagtagcagggactacaggtgtgcatcaccccacctggctaatttttgtatttttagtagaaacggaattttgccatgtcggccagactggtctcaaacttctgacctcaggtgatccacccgcctcagcctcccaaagtgctgggattacaggcgtgagccacagcgcctagcctggagtgatctcattctttttgcttagaaagattattaaaatatttcgcaaatgattggaccctgagtagattggcaagttaacttacagaactaggtttgagaaagtttttctctcagatttgaattgatttgcttgaatcatttttttttctaattttgtccaaccattagctctggaatatggtacattaaaaacaatttgcattgctccattgctgctaatatcaaggtcaatattgtcaaaaggcatggagatagaaggtcaagatgatgcctcaaacagcatcagtaatttaggacagcctgtcacaagagttaaagtgattgataagcaggaagaagtatgaacaattcattataaaggggactggatgacttagatgttaagcctactttaattttctgcatagcaattatattgctgattcacatatgaaagtattaggagacttgggataattgcagctgaggacacatcttttccattgttcgtgggacataactaaattctctgataaattaatcatagaacttatgggaaataatttaaacagcaacaacaatgataatacctcatatctctacagcacattgttgccttcagagcactttcaggtaggccattagacaaaccagtgagggagaaaaagactggcctgggaaagttaaatgaccctggttccactgaaagttcatggaaatgcagatcttgtgttaatcatgtcttctccttcagtcacttctcaattctacctcaaaagctcagactcttaaaggtttcacaccttgccttgcattatgtgcttgaagcccagcaataacactggaacttgggtaatgcagatatcgattgcccaatttacagacaaagaaactgagttgcagggaggtaatgtgacttcagtcagagaaagtgatagaatactacattctgactcctgaggattttttttcttattaatattttgagtacataaaaattgtctaatcccatgagcttgggagcttgttgacttagaaactaggtcttttgtacattgagacaggtaccgttttcctctatccaaagacaaaattgaattattttctgttacgactattctctaggatgtaatttatttttagggacctttcatttccagacttccagaagattcaaattggaatcttcttatcatcattactattctttttattattttcatatccagggtgtctataaatcctcttattttttttcttgttctactttccccagtaaataaccttttgtaagaaccacccacccccgcccccaccattccagtgtctttttattttattttttttccagtgtcttttattttgatcctgcttcaattttagaagatcacaataagaaataacatggggagagcagacctaatagagattaggatccatcattagacataaatgagacacagaagagaacaattaaaattggaatcctacaggtatgaactgttaccatataatgtttttttaaaggtgttagcctttctcatccttaaattgccttcaacaggaattctctttttggaatatgtaaaccatgggtgggatacagaagtaacctactctaaatggaagggcaaagtggtgataagattgggtttttgaatcagataatcttgagttcaaacctcaactctatcacttatgaatttgtgattgtgtaaaagttaaggaacctctgtgtggtagttaactcttctgtcaaatgggaaaatgactttgtccctcataaagaaggtgtgaagagaataaagacacacaaaataatgccttactgtgcttagtttagcttacagatggatttatgtcaaccctagatgtgcgtgggtggacagctgatcactgttattttgcttttatgactactgtatactgaacgctcactctgccaggcaatctgaatggagctagacattcagtggagaatgaaagacattagatccctctcctcatgaagtttacatgttaaaatagaaaaatataggccgggtgtggtggctcatgcctataatcccagcactttgggaggccaaggcaggtggatcatgaggtcaggagttcaagaccagcctggccaacatggtgaaaccctgtctctactaaaaatacaaaaattagtcaggcatgatggtgcgtgcctctagtgccagctactcaggaggctgaggcaggagaattgcttgaggtgagctaagatcacaccactgcactccagcctgtgtgacagagcaagactacatcgagagagagagagagagagagagagagagagagagagacagaaagaaagaaagaaagaaagaaagaaagaaagaaagaaagaaagaaagaaagaaagaaaagaaaaagaaaagtaacaatttggaaatgtacttcgaaggaaactaataagatgttattacagaaaacagaaaggacaggtacttaaagtggtcagagaaggccttttgagaggatgccccaaaaagagtatacatcgtgtaatcaaatactgtggtcaagactgttcagcacagtgcatatcctgtgcaaaggctctgagatgtgatcaaaaccacttaaaactgatgtatcatcaaggagttcatgattcaattcaactctccttaagtaaaagatgaatgtacctttttcagacatgatattttaactagctcatgaaatagatcaatttagcacaagaagtatcttttcacatgaagttaaatggttaaatttataaagttattacatattacaaatctatactccaattcttgatgaacgtttcaagaacatgttgacttttctcaaggaaaatgacaaaactatacatttcatatatatattatatatatatatatattcttatttatttatttatttattcttctgtgattttcctcagtggcatttgctaatcatctagtccaggaaagctcttgggaaaactatttatgtaaggtagataccatgataataataacgcaagagagaggaagtcacatagactaagagtggttctgtatttccaaggaggaatacattatttattgctgagaatttatgaaaaattttgcagaataggaaatctataagtcctaattctataaacatgatgaggaaacttttccacatgtggaatttcattttaataagtgactatatataatgccatatatcagcattatgcttagactggcacagagggtgtctgaagggaaatgatagatggggaaacctaggtggccccatgtaataggggatctgtattttaagaagtttaggcctttttattttatggcagggagaattcagtccaaaaactatggaaggtttacggttagaatgaaaattttctgagcaagttatcaagactatctaccaattacttcaataattaggcctaaagtaaagcatttctgaattagataagtcatttttatttgtacagaagaacacttcattaatatatttcaaaccaatggcaggtttacaagttatttaatagtggcatataagcataaagcagttggaagaaaccaatagtgatttggataatgcttgtgtatatattttcaaacttatttataaataataaattagcactccattaagaacacatgagatcatgatttggggagtggaaagggagggaacccatgcccggataaacaaagagtctaatgaatctaatgagtctgagctgggtagaaaatattaatagtagtcaacattctttcatgaaggacgtgggataaaaatgtgtccattatttgtgctggatgctgagtggtctggatggctcattgtcagaaaaaacaactttcttcactgcttttttgttctagtaactcttgctgtataatacgttagcccaaaacttagtggtgtgaaacaactgttttattttgctcatgatttttggcttatgaattataaaagaacccaggtggacagttctctcttgggatccctcacactgttgcagtcaaacattttctgggctgtggttgattggcctgctcatataagatggtttactcaggtggctggcagttgatgctggctgtcagctggaaactcagctggtgttgtcagccaaagcatctacatgtggctttgtcagctttgtattcttaaaataatcagacttcttatgtggcaactggcttcccaccctgagcaagcgccccaagagaccagagggtagctgagcctgcatggtcttctgtgacccagccttagtagtcacccagggtcaattccttcataccgtattgttgaaagcagttagtctacccaggcccaaagagaagaaacatagagtccaactccttgtaaaaagagaattaaggtttttgtttggtaaagatgatgactgctacagatttcttaatgatttgtggtcattaagaaatctatggctgggcgtggtggctcacgcctgtaattccagcacttttggaggccgaggtggatcttatcttatgtattattatattctaaacataatataatggggaccatttcttaatgaaggcattgataatgaagacctcaaaaatacatggagggatgccacgacatagttgaactctgatacattatgtaaatgaaagaaaccattcagaaaaggccacatactgtatgagtccatatatacatatatatatatatgtatatatatataaataaaatgtccagaatacacagaaaccacagagacagaaaatagattagtggtggctaaggggtggagggaaggggaaaatggggaatgactgataataggtatgggatttgggggagaagagtgatgagaggttgatggttgtacaaccttctgaatattgtacaaccttctgaatattgtaaaaccagtgaattgtataatttaaaagggcaaatgtttgtgatatccaaatgtatcttttcttttcttgtatctcaagaaaagaagaagttcacagatgaatttctaaaatctcaaaatactgtgttatcaattccaaaattaatattcttgcatacgttagcactctggaattagtctcatgatagctgtgtgattgttttctctctcagtagtacacaaagtgatgttgtatcataaaattcactacattttaaagttgataaaatatggtatatttctgattttacttatcaccagatacaaaggtaactattgcaaatctgtatttcaaagaatttacactggacaaattgttggatagatttgcctcaggctcctgagcagctgggattataggcaccaccaccatccctgactaatttttgtatttttagtacggacaggatttcagcatgtaagccaggctggtctcgaactcctgacctcaggtgatctacctgcttcagcttcccaaagtgctgggattacaggggattacaaagtgctgggccgctcctggcccagtgttttttacttgatatttataaggaggaaaggaaggaagaaagaggagaaaaagaaggaggaaagatgagggaaagataggacaggtggaaggaaagactgattttaccaaatgacgtttgtttgtttttgtctaccttaattcaaaacaagctcttgctgggaggaatggaggctgaggaagccatgaccaaaagtataattagtatcactgcaacgagctggggtaacctcaggcatgtctcagagcctctgtcgtcctcaaacatcaaatgaaggcatcaacaattgcaaacgttcaaatctactgatatttcctccactccttagttgttctttgtctagaaaactccagcctaatctttggactctgaacactcatcagaaaactatgatgtctctcttaagctctcagacatttgagtatttactctgagttctaagtgaataactgtttgagaatgagtccttcactaaattgtaagatgctccggggtcagaaaaaggctattatcttcacaactgtggcttctgacaattgtttggccaagtgctcagttagtatgaatggagggaattaaggtggggccttagcgcaccagaaattccatatcttaggttttaggtaacagaggcctaaattctggcagagcagtaatagaaagaaagttaaacatgtggctgagagaaatcaagagagatgggaaaaagaaagcgagataaactgagtccttattataggaaaaagttgattctattaatccaagcaaagtcaagaagaagaatgagtctggagtataattctctggagtggcataggagccattagcatgattttacgtttcatgtggataaccattttaaaaatgtcagtagttgtgtcttaatgtgttatagtaagaaaaaaaactaacacatcaaatttgtgatattacagttaatgtttcctaagagtgggcaaataatgacagggaattgttttaattcagttgaaagaattataatgataggtaaatgtaggtatacattgggaacgttgtggtttcagtttccagaggtttgagaccactgcaataaagaaaatggtgcaataaagcaagtgactagaaatgtttgttttcccagtgcatatacaagttatgtttacactatactgtagtctataaaatatgcaatagcatcatgtcaaaaaatgtacatatcctaattaaaaaacactttattgattaaaaaaaggtaacaatcatgtgagccttcagtgagttataatccttttgctggtggggagtcctacctcaatgttgatggctgctgactgatcagggtggtggttgctgaaggttagggtggctttgtcagtttcttaaaataagacaacaatgaagtttactgtatcatttgactcttcctttcacaaaatatttctctgtagcatgtgatgttgcttaatagcattttacctacagcagaactgctttcaaaattggagtcaatcctctcaactactgccactactttatcaaataagtttgtgcaatattctaaatcctgtgttgtcacttcaacaatgttcacagcatcttcaacaggtgtagatttcatctaacaaacaaacaaaaaaacactttcttagctcttccctaagaaacaatgcattatttgttcaactttttcatgagattgcagcaattcaatcatgtcttcctgctgtacttctaattctagttctcttgccattttcactacatctgcagttacttcctccactgaagtcttgaacccctcaaaatcatccatgagagttggaatcaacttctttccaacctttgttattgttgatattttgactatagatccttaatagtcttaatggcatctaaaatggtgaatactttccagaaggttttcaatttacattgcccagatccatcagaggaatcactatctatggcacctagggccttatgaaacgtatttcttagataataaaatttgaaagttgaaattactttttgatccatgggctgtggaatggatgttgtattagcaggcatgaaatcaacattaatcttggagctctggggtgaccaggtgcaattgtcaatgaacagtaatattttaaaaagaatctttctttgtgtgagcagtaggtctcaatagtgggcttaaaattagtaaaccatgctgtaaacagatatgctgccatccaggctttgccattctatttatagagcacaggaagagtagatttaacataattcttaatgaccttacagtttccggaatgataaatgaaccttggcttcaacttaaagtaaccagctgcattatgtaacaagagagtcagcggttcctttgaaattttaaagccagtcattgacttctctctagctatgagggttttagatggcatcccttccattaaaaagctgtttcatccatattgaaaacctgttgtttattgtagccaccttcatcaattatcttagctagatcttcttgattacttgctgttccttctacatcaacatttgctgtttcacatgtacttttattttatggagatggcttctttccttaaacctcgtgaagcaacctctgctggttcccaacttttcttctgcagcctcctcacctctctcggccttcatagaattgaagagagttaaggctttcttgtggataaagctttggtttagggtaatgttgtggctcgtttgatcttctattcagaccactaaaactttctccatattagcaataaggcttttttgctttcttattatctgtgtgttcattggagtagcacttttaattttcctcaggaacttttcctttgcattcacaacttggctcaatgtttagcacaaggagcctggatttccacctgtctcagcttttgacatgcctccctcactaagcttaatcatttccagcattaggttaaaagtgagagagaatgtgactcttccttttgcttgctcacacagaggcggttgtaagtttattaattggcctaattttaatattgtgtgtcaggaaataggtagactgagaagagggagagagaaagggaatggctggttggtgaagcagtcagaacacacataacatttattgattaatgtcactgtcttatatgggcatggtttgtgctgcaccaagacatttacggtagtaacctcttaaagatcaggattacagatcatcataacagatataaaaatcatgaaaaagtttgagatattaagagagttaatgaaagacacacaaagacaggaagtgagcacatgccgttggtaaaatggcactgatataaacttcctcgatgcagggttgtcacaaacctttaatttgtaaaaaactcagtatctgcaaattgcaatcaagtgaagcacaataaaataagctatacctttagggtccaatctgtggagaaaggaatgaataaatatggttatatcaatcagggttcccccaagagacaaaaccaacagaagatatatgtgtgtgagcacacagagagagagagatgattgattttgattttaaggaattgactcatataattgagtgttggcaagttcaaagcctgtaggcagaccagcaggctgaaaacaggaaggattcttgtattacagtcttgaggaagaactccttctttctgaaaaccctcagtttttgctcttaaggccttcaactgatcggatgaggctcactcatcacccattatcaaggataatctcttttatttaaatcaactgatcataaatattaatcaactctataaaataccttattagcaacatcaaaactactatttcaccaaacaactgagcaccatcatttagccaaattgacattaaaattaaccattccagagggaaacatttggtgaggtcagatttacaaataatgagttgcagatactgctggattatatgggtaaaaatgctcagtgaagtcttagaaatgaaagcaattcatgagcaatcaatctgccttcactttttcacctatttttattcagaaagtcacttagtctggaaaatgtcgttcatatggttgcatgccctattgttaagtgaatgagtgtttcaagggctttcctgttaggtttatttcatttagctctgttgcagcattacgatgtaagtgcttaccacaaaggtttgctaatgagtgcccttaatttgtattcagatgggagcaaagagaaggaaaaatacacaagaaggagtcttgtaattatgctacataaaattattaggcaatttagaaaattgtcagtgggaaactgcccatcatgcataaaaataattttgattttgatgtacagagtttaatgtaagagtgattgtagggagaccatgttattaatttttcccttaattatccaagcacacttgaatttattttaaggaaagtgatactttataaagttgagtcacgctactccagagaatacttgttttcgttctgtgacaaagtttattttgcagggcttgctgtgaactgtataattggtaggacgtgaaagaaccattaattatgtccttccccttcccctaatcataaataacaaaatgatgctatattttctggcaaactaaagtatatgtgatgtaaagatgttcaggtaatttgtgggcttatctattgtcttaaatatagaactacttttcactcatttttggcatacacagttgtgtattcagataattgtcagtgcaatgctaaatgtgttatgttaaaaaatgatgaacatattacctctcagttcttgttatagataatttcttgcaaattttaagctagagatagtcaatatttaatcagagaacatcttcccaggattcaaagtataccacatcagctgttgaatgcagttaatttgcattaatgtgttacaaatcaatgttctgtagtattttaggaactgtaaaacatacctttcaagacaaagtccaaactctttagtatgcaatatgtagttaacctattctggaatgtctcttctaactgagagccaccctgtagggaattaccttagtcttttaattcctgtttgtatcaggtgacttagcaaccacctgcatagcaggaagacggcaccaaggaatatattcatccccttacatagtttgaactatgtgaccaagaaattacagtccatttgtatagagtgccaagctctgaaggctggaagacatgtaagttcatgtataagcataagaaggttgtccatagaatgaaaagagaggaggagagagttaagggccatctgggctcccagagaaagtgagctcaggtcccctttgggccctaaggatgaaacaactgccctttgcctggattcacttgactgggttctttgctgtcattggtagacacatagagccctcctgtctgctttagtcttgttctaccttctcagcctcatatagcaatacctcttatattctgcccccacccaccctgaccatctcagtgatttttgaataaatcttgtctttcactcgcctctgcctttgcgtagaggatacctgctgtgcaaaggtgatgtgagaaagtcaggtctaaattcacctccagactctgcctttggtgggctgtgtaatattatgcacatcacttcaatccttagatttctcatgtctagtatggaggaaatagtacttaacatggagacttttcaggaaaattaagtgaggtattatccacacagccctcataatggtgcccaacactgtggttatcaatagattttagtaccatttttgccagaaagttgaggcagattctaatccaacttttaatatccagatctatccattattccctgattcagtccccaaggtcactcattctttcccttcagctccacaaaaaatccacttacaaatattttatacactaaatcacatcataatcattatggatttctccaaaattaaagtaacaactttttctggttctctgaaaatatgaataaaagaggctgataatgctgcatgcccagaggtgaacatggttcaataagagagagagaccttgtggaagtgatgctggaattgaaatccaaggattgagtagtggcaatggaagaagagaatagtattccaggcaaaatacatggatatagattccaggggaattatgtatgaagaaggagcatagtgaaacttaggccctgcaaggccagtgcagcagagataagcctgtttccttgggtaatggtagggactgtagggcacagtgaacagtgtttatgtcattctataaataatactgataggaccacttattgagtacttcttacatgccagaagttctttggtgctttcattacattaacttatgctattgtccacagtattctaaggtggttgctattagatttccaattttacagaaggggaaactgaggcacggggcggtgaagtaactcccagaatgttcacagtcagcgaaatggtggattctgaatacaaatgaacacaatgaggctccaggtttcctgcttattatcaccgcgaagcccagcctcagcgagcaagggaaggagctagagagcgggctcccaggcacatctgcatgtgtgcactggccttgtaacatcagtctggctcttaagagctgatcagaaagaggacagaaggggagctggcacactggttaggtgaaatgagaaagctcaatgagtgatgatggtaattcagactagaatagttagtgttattttgtgaaaggaaatttcaatttaaccagagcaccttgaagtgaaggctttgaattggaaagaaggttttaaattgctatcagaatttgccattttagtgattgaaacattttagggccaaatgtgccatgctgcacctttccagaaggaactatttgagggaaataactgtcagctcctatagtaccagtgtttaaaatgtaagtttagggagaaaggcagttcaccttctctccaggtggggactgactgaggtgttgaacaaccagatttggggatggtattttttgaatttaattaactgctacatgtgaactagtaagatcaaatcacccacaaggtagatatttgagaaactcagtgtaaatgtggaaaagttgatgttatgttccaaagatgtaataaaaaattaaccagtttatgcaaatgtttatgcaaattaaccagtttatgcaaatgtttatgcaaattaaccagtttatgcaaatgaaaagaggaggtaagaaggtataagatgctatgtttgcatcattcactgggaacatttgaactttgcagattaatgtccttggtggaagaagttatgacattatgttatttgttggggaaaaaccctccagtgtaaagacttttatttatttatttattaaaggcaggatctcactctgttgcctaggctggagtgcagcagtttgatcatagcttactgtagcctcaaattccagggctcaagcaatcctgcctcctcagcctcctgagtagctagtacaatacatgccaccatgccctgctaatatttttttcttttttttttggagacagagtctccctatgttgcctaagctggtctcaaactcctggtcttaggcaatcctcgcacctcaggctccctcagcactggattacagaatacttaaaaataacataaatcagtcagatatttaagcctcacaaacttttcctgaagatttactgagctacttcttcagatgaaaaagacattttgtaataaatggtttctgaaaaaccaaaccctcaaaattgtaactgggatggatatgattagtgaaacacattaaacttaaccctacagggataaaccaagagcgctactgatgtttataaggaaatacaagcattacatcttaaactagacaagtttccactgctgagctaccctgagcttagtgaaattaactattttcacaaaatggaaatccattaatggaaatgacatcataaattcagaaaagattcttagattttaatatacttttcctaatttaaggcaaattgagccaccaagaattgaaagagaacatatttggataattgaaaggcagagtttaaacattccggaaataactatctgcactttcaaatgcaaggtcttgcttaggtttggaacaacacaggttttcttgatcacttgtctaaaacagtaactgagagccacacaacacaacctcgttttataaaggttgtctctgatacttagaaaaatctaaatgtttctgtacttttgcaagttactaaagtctttccattaaattatttgacttttttttctcccgcccaaaaagtgattagcgcacaacaaaatgtgtgtgatttgttaatggagtattctttcattgcagatttatatgttcttaaaacagtgcaagccttttgtggaaataatgtattttgaaatcatatattcttatatacatgtctctaaaagttcatcaaataaaacgtaggaatagacatttttacaaacagaaaacagtcatgtggttctgctatccaaacacagtgacatgatcttttagagtttattttcagtcttttacatattgaccctgtttttcctccatatttgtattcttttaggtttgtttacagagttgtaatagagcatttgtgtgaagcagtttatatggtaagtgacagaaattcagctcagagacactaatatactcacaggatgtattggtctatattgttcctctaggaaggtgtgatccagaaactcaagagaagtcatcaaggactcagtctctctacatatttttcttcctttataagtaaatggcctgcaaatcttttctcatttctgccgctctccctgaaggacctggtagagtacttccttttgaaatatctggctgcagttggcctatagctcagtctgggtttctggcttgttctgtgcatttgtttttcgtgcttcaattagccattgtgtcctggtaatggaaggaaacaatcctcagagatcttgtcacactaagtctgtggcacaatttgaaacattcagtaataccagctgttctaagcagaacagaagtcataattagggatgcaatgatttcacactaaactgtagttacagaatatataactacattttaatgctcatcaatttttatcttatactgtatttatcttcaaagaacaaatgaaccaagtgaattggatttcagatacacagagctggatttatctaatattccctttctcatcttctgctgtaaaaaaattatttcttcttatgtaaactacctaagaagtatcttttcctcccagaatactgtagctttgtctgctcaaatccaaattatataaaatggcaaagctgctctggaacacattttggctgtttaatacacagttaaacatacaatttccatgtgacctcatcatcccacatccaggaaattatcctaaagaaataaaattgatgttcatgtataaacctgcttaataattttttagaaaagtaccattgccaagaactggaaacaacccaaatttccttcagtgggagaatggacaaaaactatggtatatgcataaaatggacaataaaaagggaaaaattattgatatgtgcaatctggataaatctgtagaggcatcagtataagtgactgtagctagattaaatactttgtaattccatttatgacattctgaaaatgtaaaagtatagggacagattggagattgccagggattggcagtgacagaagggtgtgttaattacaggggcagcatgaggcatttctttatggtgctgggatcatcagtatctgtttgtgctggtggttgcaagaatcttcatatgggctaaaactcatacaactgtatagcaataatgtgaatattactgactgttaaataagatatctatgagtgaaccttcactaggcaaataaaataaataagtattaacacctgtgactcatatctgttgtcattttccaaagcttgaagcccagcataacatcatgcttggttttccaattcatcatgcttttgatctttgtatgacacatgcagaatttgggaaacatcttgggagataatgagtttttagtaatttgggagataatgagtgctatgttgggataagttaacacttgttttgttaaatattacatggaagggaatagagaaaaagtctatgcggcaacaatgatgtactcttagcatgacacatggaagcttatgaaaaattattaaagactttgcactcagttaccaaaaaaaaagtctattatgtaagagatctggatcacccccagcagatgtagggctgaattgttggttgctgttcatctgtaaaaaatgaatttcccaaatgcttctctagtgcttattcagctctgcttagagaagttttatccttgcatttatttttttcttttcgtggccatagtgagaatggtattaagaactgggctaagccccagttctgcatctgcttgctcctttaaattagtgagagcaagctcattctagttcagttcctgagtagctgtaattaatggtttgtagtattcacatggcttttgaaaaggacccctttctctctttaaagcacctttaaactttctagaaaaaaaccatgtaatactgccttgaaaacagtcccttctgggtgtcatttcaactactttcggttcaacttcaagttgtccagggaaaataaacccatcaagtagtgcctgcattgttagcttgagaaccagaaggaacttcgaccacatttgcttttgagaatgtaataatttacatgtgatatatgatcgtttagttaagcaacagtgatacagaggagcttcaccttggcctcatccattgattgtgcagatttcaatacacttgtttaagctttgtggatgtggttgttcattcaatcaacagaagtttacttttgcctatcctggaccagaaatcagacataagctcaggatattaaaagatgcttatatgtgtgtttggggaaagggataagaaaatgtagagaaaacagagaaaagtacatgttgtgagatatgtttgataaaatctgggttgatcaaatttaaacaagattccagaatttgtaatgtattaatatgcacaatgacctttcaagaatggaatctaatgtgcaatgattctcaaatctctctgactgggaaagcccctgttaatttttctcagagaactttataattgtagtatccttttctacacactttgcaaaatgtatggatgttagcaaaaaaaaattatcttttatgtattgattattatcagcaatgcttcttactgcctcagagccagagaaattgcaagcagtgcctgaagtgttgtttgccaagcttctggtaacatacaacattgttttttgttttgttttgttttgaattactgtttatcaaatagaaatttagctatgtcagtggtcagaattgtggaaatagtatacatacaaacttgttttgttttgggaagaactagatgattaaggcagctttgctatgtggtaaattatattttatgcctgggtaacagttgtcaactaaaaatgggagatttgctgtcagaacttgttgagagtggcatgctcagtgtataagtaggtttcctgccataactacattgagtatatgcattatataaatgatatatgagtttttagtaatttgaagagaaatgtaatacctaaatacattttcctttctgttacttaccccatatagttttgcaacatttagtgccaagctaaggtgacttttgattattgaattaacttcttaattccaaagagtttgtgcacatcaatagaattttgttcaaataaattagactatagactaaaaacaatttctagaaaaacatgttggcttgccacttaagattatttctctgatgtctaaaacaaattgaaacttagtttcaatgtagcattgtatttaatataatcataatttcaactgttttaggaaaatattttattaataaaccaccatagtccatcaaacagataatctgtattatactagcatgttagcttaaaatgattttgtatatattatcgttataattatatatatctaatgattgaagaaagagaactgatccactacattgttgttgaaagtgaatttagaatgagttatatgttaatgcaatcttgctatctttggctgattctggaaggagttgaaaccttaattgatcaatcacttgattcagctgaaacttagagtgaagatttaaagtgttcttaatttgatcaaaatggcaatttttttttctgaatccaatatgtggagggaaacacaaggaaacagtaattaccattatgaaagtttcatgaaattatggtgacacttttaagtctattttttaaagagctttattgagaaacaattcacatactatgtaatcccccttttaaagtgggtcatttaaaggtgttgatattcacatagcagtgcaatcaccgccactatttaattttagcatattttcatcactcagaaagaaacctcataccattagctgttagtctacattcgcccattttccataacctgacaaccactaatctacgtatgtatttgtctagtatggacatttcatacaaattgaatcctacaacatgtgatcatttgtccctggcttctttaaattaacaaaattctttcaaagtttatccgtgttgtagcatgaagtacttcagccttttatgagtgaataatattccattgtatgggtatatcagattttctttattcattcatcagctgatggacatttggcttgtatctacattttagctatggtgactaatgcttctatagacatttgcccaaaagtttttgtatggacatattttttcacttcttttgagcatgtaccctagggatggaattgctggatcacatggtaattctgcatttaacatcttcagtaactgccaaactgttttctgttttgcaaagtggctctagcattttaaatcccaccagcaaaaatgtgaggggaccaatttctctatatcttcatccacagttattattgtctgccttttttgatattaatcatcctattggatgtgaagtggcacctcattgaggttttgatgtgcatttcttgatgaatgataatgagcactttttgtatgcttattggccatttatgcatttttggagtaatatttttcaaattattttcctatttaaaaattgggtgatttgtgtttttatcattattatatgacattttcatatgttcaggatacaaatcccttttgaggcatatgacatccaaatatttatccattttgtgaattatcttttcattttataaaattgtatcctttaaagtgcaaaagagttaattttgacaaagttaaatttacacatttcttttttattgttgctgaccttttgttgttatttctagtaaactatcacctaactcgaggacacaaagatttactcctatgcttcttttaaaatttttatagttttagctcttacatttaggtctatgatctattttgagttaactcttcatatggtatgaggtcaggttccaaatttattcttttggatgtgggtatctagttgtctcagcagtttatttaaaaaaaaattctttcctccactgaattgtcttagcacccatatagaaaatcaattgaccataaatgcaaagatttatttctagactctcaaatctattccattgatctatatgtatattgaaatacaaattccataggtcttgattgctgtgttgattactgcaagtttgtaacaagtattgaaattatgaagtgtgggtcctctgctttgttctttctcaagattgtttggttattctggaatcttgaaattctctacgaacttaggattaacttttcaattttggcaaaaaggccagctggggttacagtagggatcacattgaatctgctcatcaacttggggactatagatattataacaatattaagtcttctgattcattacattgggtctcatttcaaatatttaggctttcttaattttttcaacaatgtttgttgcataatggaagacttgtattgtttttcttaagtttgtttttaagtattttatttgtaatgctattttaaatggaggttttttttttagagtttccatttctctgcttgcattacccatctgcttttgtatgttgtccttttcttttccccattagaactcttagcaaattaatcatagttattttaaatttctgttctgctaattccaaaatgtgtattatatctaagtcttgttttaacgcatgctttgtctcttcaggctgtgttttttatttgtttatttgttttcttttggtgtgacttgtaattattttgttgaaagccacacacggtgtattggataataagaactgagaacattagtctttgattgagattttatgttcatttgccaagcaaatgtgtttactgtttgttgtagttatgatttcagacactaaatttttatctaatgttgtgtttgagtcttgcctgttgtctttgggttctcctagagactccttcttaaatagttcattagccttgtagttttttgttctagcctgttattatagaagagtcctattgatgtggtgataagctgccgtgagaggggaagcattttacaaacctgtgattagatctgaaccttttagtgaacatgtgtccctgagatgtgaccatcacaaataattcttggctttccaccttcctctaaggtaaaacgggttttgctagagtctaaccaacctcagacaaaggaaatacccaactccagcccactctagcctttcggctcaggtagtattatttccattgagggcagacctttcttaagaacagagcactctgggtatatttcaaaatacaacaccagaggtttttctcccatcttcactctgagacccctggtgggactcctgaaggtaaaagttatgaaagtgtgtgagggctcccgctaaagctgggacaagaggaattttaatttctcattatagtccacgctcagtctccagtagtgagtaagttcatttttaatgatttatgactgttgttgtctccaatagtggcttccgttgttccttgtaagctctatgtattcaaatgtgtctctagttttgtataatggttgtttgccctgtgacctaaattctctgatatatctaagaaaagttatctattttcaggtttttttttttttagcttctttcttgttgtgaggacaggaaatggatgacagctttcaagctttttaccttttggactgaaagttgaaagtcctcaatggaattattattattattattattattattattattattattattattattattttgagacagggtctcactttattaccccagctggagagcagtggatgtgatcttggcccactgcagcctttgcctcctgggcttaagtgattctccagcctcagcctcctgaatagctgggactacagacatgcaccaccacgcccagctaatttttgtaatttttaattttcttttcttttggtaaagatggagtttcaccatgttttccagactggtctcgaactcctgggttcaagcaattcatccacctcagcctcccacagtgctgggattacaggcataagccactgtgcccagcctggaattcttttcttaatttcattttcagattgttcattgctagtgtatagaaatatgactgatttttgtatataggcctcatatcgtgcaatcatactgaacttttaaattcgttccagtagggtatgtgtgggtgtgcatttgtgtgttttggtatttttgcaagataatatcatcttcaaatagagatggttttactttttcattttcaatcttgtcttttatttctttcttaactgattgtcctagctagaacctatactgcaatgttgaatataagaagcaagaacaggtatgttgtctgttttttattttagggggaaagcgctctatcttgcatcattcattataatggtgttggtttttcataaacgctccttatgagtgtgtgaaagttcttttttattcctagttttctgacagtctttcttatgaaagaatgtgagactttttgccaaatgctttttctactatcatggagattataagttatttatatttgtcctttagtctattgatatgatgtattacatcgattaatttttggatattaagacaaccataaatttatacaataagtaaaaaatgtttatgttgtacaatcctagttatatgttgctagatttggtttcttactattttgttgagttgtattttgtatgtctatgttcagaaggaatattggttcgtagctttgtgttcatgtttgttttgcttttccttgtgaggtctttcttgcttggttatgtatcagaataacactggtctcactttgagtcaataagtgattcttcctcttcctttattttttggaagatttacaaaggactggtattaattcatctttaaacatttggtagattttatcagtgatgtcatctgggcttggtcttttattgtaggaggttttaaaattactaaactgattttatttatttgctatatatattcagatattttatttcttcttaagtcagattttatagtttgtacccttttaagaatttgtccatttcattaagattatttaatttgctaacaacagttgttcatagcattccttattcttcttattttcctctaagtttggaagtgatatctcctctttcatttctggctagcaatttgaacttctgtattcatggttagtctagttaaaaatttttcaatttggtcgatctttttaatgagctaaagttttgttttgttgagtttctctatatttttagttctctactattttttccaatctaatctttattattttcttttcttctgcttatttagtttgctcttatttctccactttcttaaggtatatgtttaggttttgatttgagatatttcttcttttttaatataggcatttgtgcctattaatactttactaagcacagcaatagctgaatttcataattgttggtacgttgttttttctgttaattgatctgaaatgatttcctaattccccttgtgaatttttttcctttgactcctttgttatttaacagtgtgggttttgtttgttgtttgtttgttttttacttacatatatttgtgaatttcctaaatgtcctttagttaatgatttctaaaatttcatttcattgtgttcagaaaatatactttgtatgatttcaatatttttaaatgcataaatgtttgatttatgtcctaatatgcaatctatcctggataatgttctgtgtgaactggaaaataatgtttgatgtttttaggtggagtgttttatagatgtctgtttaagtctggatagtttctagttttgttcaagtcctctatttctgtattgatcttcctcttagttgttttattcattattgaaagaaggtgatcaaaatatccaactattagggctgaattgtctatttctcccttcaattctatcattttcccacatatatttcagtctatgttgttaggtgtatatatgtttatattaataattaacgtatattactgatacattaaaaatttatcattataaatttcatccttttcctgagtaataatatttgtcttaaagtctctttcgcctgatagtatgttttgagttatttgcttagtttttgtccaggggattgcaatttacatgttaatttataacaatctaattggattagtagcaaattaatgtcaaagcttaaactcctctttgttctattattgacatacaaattcattttttacattataagtcaatcaacacagttttatccttattgcttgatacagttgtttttaaatcagataggaaaagaaaatccttacaaaacaagtatatttatattatctgttatatttacctatgtactttaactagtgcttttatttcttcttgtggatttgacttcctgtccagtattccccctttttatttaggttgtaattttttcttaacatttgaatgataaaatgaataaatatagactttttagttggtagtctttttcttttggtgctttgaatatgtcatcccattgccttctggactccatggtttctaatgaatagttagctgttcatcttattgaagactccttgtgtactgtaaattttgtgtttttttctctttgcattcagtctttgacctttgacagtttgactatgatgtatttgtgtgtgaatttctttgaatttatccaaatcagagttttttgaacttccaaaaatgtagattagaatttttcatccaatttttaaattttcagttgaaattctttaaatattttttccgctatattctctgttttctttttcttggcctctcatccatcatgcacatattagtaagcttcatagtgtcccgtacgtctctgagtttctgttcatttttctttatttgtttttctttctattctcagactggataataatcaatggatctatctttaagttcaccggttcattattctgacagttgaaatctgctgccaacaccttcttgtgaatttttatttcaataattgtactgtttttgaccaaacttcaatttagtactttttttgttgttgttaccatgtcattctgctgaatctatttagtacttttttatagttgctaatcctttattaataatctcagtttggagaaatcagtcccagactttgctttatttctttggatgtggtttcttttacttctttaaacatatttataataggtcattcaatgtctttttctagtaagtccatcatctagtccttctcagaaacaattttagttgactatttttccacatatgtttaggccatactttcttgtctcattgagtaccagtttttttgttttttgtttttttttgagatggagtctcgctctgtcacccaggctggagtgcagtggcgccatctcggctcactgtaagctctgcctcctgggttcacgccattctcctgcctcagcctcccacatagctgggactacaggcacccaccaccatgcctggctaattttttctatttttagtagagatggggtttcaccatgttagccaggatggtctcgatctcctgacctcatgatccacctgccttggccacccaaagttctgggattacaagtgtgagccaccacgcccgaccattgactaccaatttttaactgcacattttaaataaaataatatgccaacattgtaaatcaaatacccctccccttttgcttttgttatttctacttcttggttttgtttttgttgttgtttgcttttagtttctttcatggactaattttgtatagtttgtgtttttggtcatgagtaactactaaagtatttactgggatggtttggtgtcagctaatggttggaatattgatttccttcaatcacttcaatcaatatgtttccgaccatctgccaatgggctctctacttgtgctggggatgacttcaatctttggctgtttacaactctgttttaaccttaacttttatttatggaaaggctcaacaacagtcagtgtgagatgttatgacattttcaagtcttttctaggtatgcacacagacttttaatgcaactttctagatccccaggaatatgttagaccttttcaaagttccttattttcctgatatttaagggttttggtggcttgcctcttatttgcttcaactggtatcaccacatcagaaagctatgaaaaacaattgcctccaattgttttcaataaatgccctatgaatagggcttctcaatgcttgaattctgagtcagggcaagtaaatactagcctcataaaaggagcttttccatgaggaaaagccaaagagatcaactagtaacagttctataatgatgaaaatgcttgatctccaaactccttcttccctgtcctatgtatgctgggttgctgattttcacagctgttactgttttgagtttgctaatttttaagtctatggaactaaggtgagaggaatgagaatgcagttagtgaaaatgccataaagctcactgttcttgccaagatgtattcacttattttgaataaattgttctagcatttgtataagcctttacaaatgtcaagagtaataacaaagtagattttgacaattatttgtcagtgttctaatttcttttagggaggagtaggttttcaaatgtccctattccactattcggaaagtgctttcaagtctacaactgccttgataccagaaatcaagttagatttataaaaggggttaatttttggcctactcacaaatatctttgctaaattttctggaagcaatcatcaaaacattaaaaaaagataatgtcttttcttctctgtgataatcctattagcatactatgtttatcttcttgctcaaaatctgcatacatgtggagaatattcttaaaaaaatggacaatacatattattctgcaacttgagtgattttacatagaaagaaatgggcattcctccatggatataaatttacttacatatattgatctgcttatcaaacttattctttaatcactctcataattgcacaggatggatctgttatgtctccttcagaccagatattcaggtttatagcatattttttaaacacaaaaaacaaaacagcaaatagatttacatactgctgccttcattcctatagagggaggtccattagagaaaacttaatgaatcaaatgtttgtgccaatttatttaataaaaagcttctgaatttttactgttatgcatatgtgcagatattacactgaaaaaattgtatctgttcctaaaataagttatcaaatcgtgtatttgtacccattaatcaacttctcctcattctttcctcctctcaaacagtctaccttctgttttcatgagatccatttttttcagctctcacatgtgagtgagaacatgtgatatttgtctttctgtgcttggcttatttttcttaccacagtgaccttcagttccatccatgttgctgcaaatgacaaaatttcagtatttttaatggcagcatagtattccattgcatatatacaccacattttttttctgtatttcttctaaaaaaaaaaaaaaaaaaacaggatacatgtgcagatcgtgcaggtttgttacataggtatacctgtgccatggtggtttgctgcacctactggcccgtcctctaagttccctcctgtcatcccacaccctccaataggccttgttgtgtgttgttcccttctctgtgtccatgtgttctcaaggttcaactctcacttatgaatgagaatatgctgtgtttggttttctgttcctgtgttagttgctgaggatgatgatggcttctagtgtcatccgagtccctgcaaagacataatctcattcctttttatggcagtatagtgttgcatggtgtatatgtacaacatttccttatccagtctatcattgatgggcttttggttggttccatgtctttgctattgtaaatagtgcaacaataaacatatgtcttcatgtgtctgtatagtagaatgatttatattcctttggatatatacccagtaatgggattgctgggtcaaatggtatttctggttctagatcgttgaggaatcaccatactgtattccacgatggttgaaataatttacatttccacaaacagtgtaaaagcgttcctatttcctcacagccttaccagcatctatggtttcctgacattttaataatcgccatttttgactggtgtgagatggtatctcattgtggttttgatttgcatttccctgatgatcagtgatattgagctttttttcatatgttcgatggccacgtagatgtcttcttttgagaagtgtctgttcatatcctttccccatgttttgatggggttgtttgtttttttcttgtaaatatgtttaagttccttgtaaattctggatattagacctttctcagatgggtagattgcaaaagtgttctcccattctgtagattgcctgttcactctgatgataatttcttttgctgtgcagaagctttttagttaattagatcccatttgtcaattttggctcttgttgcaattgcttttggcatttttgtcatgtcaatgtcctgaatggcattgccaggttttcttctagggtttttaaggttttaggttttacatttaagtatttaatccatcttcaattaatttttgtgtaaggtgtgaggaagaggtccagtttcagttttctgcatatggctagcaagttttcccagcaccatttactgaataggagatcctttccccattgctggtttttgtcaaatttgttgaagatcagatggttgtagatgtgtgatgttatttctgaggtctctgttctacttcataggtctatatgtctgttttggtaccagtaccttgctgttttggttgctgtagtcttgtagtatagtttgaagtcagatagcatgatgcctccaggtttgttctttttgcttaggattgtcttggctatacagggtcttctttgattccatatgaaatttaacctagttttttctaattctgtgaagaatgtcaatggtagtttgatgggaataacattgaatctataaattgctttggggagtttggccattttcacggtattgattcttcctatccatgaggatggaatgttttttccatttgtttgtgtcctctcatttccttgagcagtgctttgtagtcctccttgaggaggtccttcacatcccatgttagctgtattgctatatattttattctctttttagagattgtgaatgggaattcattcatgatttggctttctgcttgcctattgttggggtagaggaatgcttgtgatttttgcacattgattttgtatcctgagactttgctgaagttgcttatcagttcaagaagtttttgagctgagatgatggggtttcctaaatacaaaatcatgttgtccgcaaacagggacaacttgacttcctctgttcctattcgaatactctttatttctttctcttgcctgatttccctggccagaacttccaatactatgttgaataggagtggtgagactgggcatccttgtcttgcaccagtttttgaagggtacttccagcttttgctcattcaatatgatattggctgtgggcttgtcataaatagcttttattattttgagatatgttccatcaatacctggtttattgagagtttttaatatgcagggatgttgaattttatcagaggctttttctgcatctattgaaataatcatggtttttgtcattggttctgtttatgtgatggattgtgtttattgatttgtgtatgttgaaccagctttgtgtcccagaggtgaagctgacttgatcgtggtggataagttgtttgatgttctgctggtttccgtttcccatattttattgagaatttttgcactgatgttcatcagggatattggcctgaagttttctttttttgttatgtgtcttcccggttttggtatcaggatgatgctggcttcataaaatgagttagggaggagtctctccttttcaattgtttttaaaagtttcagaagtaatggtaccagctcctctttgtatttatggtagaattcacctgtgaatctgtctggtcctaggctttttttcgttggtaggctattcattactgcctctgtttcagagcttgttattggtttattcaggaatttgacttcttcctggtttaatcttggtagggtgtatgcatccaggaatttatccatttcttctagattttctagtttatttgcatagaggtgtttacagcattctctgatggtagcctgtatttctgtggggtcagtggtggtatcccctttatcattttttattgtgtctgtctgatgcttctctcttcttcttctttattagtctagctggcagtccatccattttgttaagttttttcagaaaacctgctcctggactcattgattttttggagggctttttgtgtctttatctccttcagttcttctctgatcttagttattccttgtcttctgctggcttttggattagtttgctcttgcctctctagatttttgaattctgatgttaagttgtcgatatgagatcttcctagctttctaatatgggcatttactgctatatatttccctcttaacactgctttaactgtgtcccagagattctggtatgttgtctctttgttctcattggtttcaaagaacttcttgatttctgccttaatttcattatttacccaggagtcattcaggagcaggatattcaatttccatgaaattgtgtggttttgagtgagtttcttttcttttcttttttttttttttttttttgagatggagtctcactctgtcacccagactggagtgcagtggcacaattggttttgagtgagtttcttaatcctgagttctaatttgattgcactgtggtctgagagacttatgatttccattcttttgcatttgctgaggagtgttttacttccaattatgtggtcgattttagaataagtgccatgtggcactgagaagaatatatattctgttgatttggggtagagagttctgtagacatctactaggtccacttgatccagagctgagttcaagtcatgaatatccttgttaattttctgtctcattgatccatctaatactgacattggggtgttaaagtctcccactagtattgtgtgggagtctaggtctctttgtaggtgtctaagaacttgttttatgaatctgggtgctcctgtattgggtacatacatatttagaacagttagctcttctcattgaattattccctataccatgacataatgcccttctctgtcttttttatctttgttggctgaaagtgttttgtcagaggctaggattgcaactcctgcttttttttgctttccatttgcttggtaaattttcctctatccctttattttgagcctgtgtgtgcctttgcatgtaaggtgggtcttctgaaaacagtacaccaatgggtcttgactccttatccaatttgctggtctgtgtcttttaagttttggcatttagcccatttatatttaaggttagtactgttatgtgtgaatttgatcctgtcatcatgctgctatttggttattttgcacactagtagatgcagtttctccataatgtcattggtttttacattttggtgtgtttttgcagtggctggtaccagtttttcctttctgtatttagtgcttctttcaggaacccctgcagggcagtcctggtggtaacaaaatccctcaggatttgcttgtctggaaaggattttatttctccttcgcttatgaagcttagttttgctggatatgaaattctgggttgaaaattattttctttaagagtgctaaatattggcccccaatctcttctggcttatagagtttctgctgagaggttcactgttagtctgatgggcttccctttgtagatgatctggcctttccctctggctgcccttaacagtttttccttcattttaaccttggagaatctgacgattatgtgtcttggggttgatcttctcatagagtatcttagtggtgttctctgtatttcctgaattttcatgttggcctgtctttctaggttggggaagttctcttgaataatatcccaaagtgtgttttccagtttgtttccattctcccttctccttctggtactccaatcaatcataggtttggtcttttcacatagtcccatatttcttggaggcttttttcattcctttccattcttttttctctattcttgtctgcatgtcttatttcagtaaggtggtcttcaaactcttatatcctttcttctgcttggtcgatttggctgttgatacttatgtatgcttcatgaagttcttgtgctgtgtttttcggcttcatcaggtcatttatgttcctctctaaacaggttattctagttagcaattcctctaaccttttatgaagtttcttagcttctttgcattgtgttagaacatgctgctttagctcatcatagttttttactacccatcttctaaagcctacttctgtcaattcatccatctgattctctgttcacttctgtgcccttgatggagagatgttgcgatcatttggaggagagacactttggccttttgggtttttggcatttatacattgattctttctcatcttcgtgaatttgtctacttttggtctttgaggttgctgatccttggatggggtttttgtgggggctttttgttgttgttgttgatgatgctattgttgttgctttcttctggtttgttgttctttcagtagtcaggtccctcttctatagggctgctgcagtttgctgggggctcacttcaggctctattcagctgatttgctcccgtgcctggagacgtcactgaaggagcctggtgaacagcaaagatgggtaccttttccttcctctgggacctctgacctcgaggggcaccaacctgatgccagtaggatcactcctgaatagggtgtccgacaaaccctgttggagggtctcacccagttgggtaggatggggaacaggacccattttacaaaacactttgtcctttggtggagagagtgtgcttcactggggggaaacccactcttctgggctgcccagattcctcagaactaccaggaggtgaggctaagtctgctgctttgcagagactgtggccattcctccctttaggggctcaggcccagggagatccaaaacctgtccctgagcctctggctggagttattggaggtcctgcaaggaagcccagcccactgaggaaggatgggtcagggttaggcctgaagaggccctctggccacagactgccacagccagtgtgttgggctgtggggacaagtcttgggaccaaaccttccagcctttctggctccagcaggtgaaaagtgcagcctggagctgtagaaatgggtgctgcccttcccccacccagggagcttagtgtgttaggcagttgcaagtcccagtgctggctgccccttccccaaggagcttaaaccacttagacaacaggcagctgcagttggtgctggtcacccctcaccccaggaagtcattaggattaagcagattccagctgagaggctgtaacaatctgcgctttctggggttgggatgctaggcccttggtggcatgggttcatgagtgggatcttcccttccatgggttgcacagttccgtgaaaaaagcagattgcccggctgagtagcacgctcactcaccacctcccttggctggggggagggggttcttctttcccatgtggctttcaggtgggccaccacaccacactgctcttccttctcttcatgagtaggaaatagactagccttctagacaattttgatgacagaacttggatacctttgttgctggtgatggattcacatgcttattatgtttttttttttttcatatgagtctctgaatgccagtccttctagtcggccaccttggtcctgaccctaaattattactttctgtacattaacttctactatacctttgtgtttatttatgaaatgcttacttgtttcttagggcttatttgtccaattctaggtcaatatactattatttgtaatgttttaaagtcaagaaagagtgtttctcatctttttctccagcatttttttagttcttagatatctgttctaccatatcacaccaaagtcatttgctgggtttttgtaaaatcaagattttgtttgaaattgtattaaatgcatatattagttgtgaaaataattcatttataaatatatgatatctcctgcatgagcacaggatattctctgtttgtttgtggttcttttatgtaattttcaataaattttatactttaaaacaaattatgaccttcaactattttattaaatgtgtctttctttcttcttttgagagggggacaatgatgataagcaaaaattgcccccatatgtataacttacatgttttattaaattaccttaggattttttaactctttagtaatttctagggtttttcaaagtgtatcatcataatatctgtagagtttacttttatgtttcttatggaaaattgatatttattacttaatttacatatcctattacattagttaaatcattaaagcaattctgagtaattgtgaatgggaagtcctgatttctattttactttttaaaattaattaattaattagttatatatttaatgttgtgttcttggaataaaattaatttggtcatggtgttttattcttgtaatacactactggattcactttgctagtatttcactttcaattttatatccatgtataaaagtagtatgtatatcatgtttttatggtattatgtttattagctttagctattgataggttttattgttgttactttagctaataatatgttttgttgttgctttgttttgttttaggtttcataaaataagttttagaacattgtacgttattcagctgtttaatattattgatgtaaaataggtataatctcttatattaaggtaagtagagcatatctggaaagccatgtgggcattaggacattttctaatggcagattatgtttcccatcttttctatgatcactggactctacaggttctctatattttggtatttaatttgagaacatgattttctgttgaaaatcatcctttctctagatttgtattattttcattaccaaatttgcccatattttttgaaatttttgtaaatatctcctctgtgtacatacttacatctcatttattatatataatgtacatttttacttctctcatttaaaaaaaaaatcctttctactagtttgcctgtttgattttttttttttttgaacagccttcttttagttttatttatatgtatgctatacttttgggctttttgcttcattaatgatagttttttacttctttaattctccatcctgttattttggttgattttgatgtttcctgtgtctcggaggctttgcagtgaaacttgattgttaatgtaattgagattcagaagctatgagatgtggctaatatcttatctgtaacattgcttaaacatgactttgtggaactcttgtggagatggtaactttttcctgaatgcttgaatcagctttgaactatgcaatcaatttacctgtaatccaggaggctgcaagaagataggtcccatggtaaatgattgcaattcttttatctggattcataaaaatcatctgctaaacacttaagacattatattatattagcttacattaagtactctgctttttcatattgcctcacactaattattatgctttggttgcaaatgtattttaaatcttaagagcaatccaaatggcagttttattgtttactgtggtccttgctgactatagtaaattgtttgctgactcagcttaaatttagaaaatgtgcacatattttggatttcttcccagaaatgaatgtggctataggtaatataaatacataacaaatccccttggatttagaaatttgtggaatttcctttggcattgcagattagcagttaatccttctttcttagctaggtttaaatattggagcaatttgtagactcttagaagtaatagttttatctggacactgattattttgctggaaagcaagaaatcaggtccacacgaagaataccaaggagagaaacatatgttaactttaaaaaacaaacaaaaaatgtcaatttgtatattggtattcaagtgggagcgataaaccattaatacacatataagggatttcggagaaaatgttttggtagcagatttctgtccttggcatctgtgatggagggaggatgatttgcgagtcaactgtactgcggtagaaacaacattgggtttcatgttagtacatgtagtttcaaatccggggtctgctattcactgtttccatgaatttgatagtcactttcattcggaaacttcattttcacatgcataaaaagttgtataaatatcagtactttgtacaagaggccaattcaatgactgtcctggttttgcagggaaaatgaaccggcccgcacagcgatgagagagtgctgtagtaacatgggcattggaagaggatccccgcaaatctttaagaagagggacaaaattggttcctagatggggaaaaccaagggtggtgtattaataacagatgaaaataaggaaaagaattaaattactttgaaaattctgagggaaagggaatcttcaccacatcatcagaatcacacacagcctgctgtggtgaccaatcaccagtcagatcaccaggaggctctcttactaaacgttgaggatatttgcaagttttagtccataatgcctggcatccgagtagagactcttgtcccttacaattttactttctttccagagcttgataatttagttctgatacctattattgtgggattgctgttgtactgtaggcaaatgactcacttcctcaagttcgaatttcttcatttttacagagatggtgatgatgccttgttgttagagtgagaatggtaggatataatgtgtgtttacattcactgacctggtcccttgcctagcattaattaatgattgatgcatgtgaattacctttccttctgactacttgatatgtttcattaggcattcattcaattaatagtcattgattctgactctatgctagagacactactcagtgttacacgtgaaacaagattcctagtcccagcataatggagcttgcgaatgaaagagggagatagatattaaatcagtcatgccagtaaacataattataaattgtaaggtggaatttgaaggactcatagaaagttctttggcctggttaaagacgcattcacagagaaatggcaattaactgggatctccaatgtcagtaagagttaataaggcaaaggatgggtttagtgagaaggagatccacgtggaagcataacatgggcaaagtactagcttcaagaaggcttatggaacatttgagcaaataaggaaacagcagggtggctggagttcagagaggaattgggagatggtgcagcacagtctccatgcccttctgcttctgctttacttttaaggctcagtgttacctatggaaagaaaaatagtcagagtctacacatttatcaaattcatcagccagaaatcttatcagaaacaaaaagtaaagccttcaggtgaggactattgagcaccaaagatcttatttctgtgtggatttttttttttttttttttttttttttttttagtgaaataagatacatcgaggaggcaggtgcatagaagtcacttggaagtgacttctaacaggcctgttatgccagctggtttttggtgttgtaggctgaacgtgaagttgatataattgggctcagtatgtgtctttccttagagggagacagccgctagaataataaatcagcagtggaactttcaatagatacttctggaatgtctttgacttttacatacctctcttggcatttagatttgaatctgattttcagagaagaaagggttatagatcacaatctgagtcttcaacagcatatttgtagaccttagaggagtaagaaagaaggggagagggagagaaaaaagccctgggacaacttctgtgatgttaggatccaggggatgcacttggtttttttctccattgtgatatcccacttgacacatcacgattacaaatgatgagtagcctaggacaaaaccaccagcttcggtaatttgagttatcactcatgtaataaatatttattggacacctgtattgttctagatggtaaaaaaaataaaaaataattatgtttctttcaagcacttcatagtccttttgggcgctagacatgtggacaattacaataatgcagattaacttttttaagaacacacagtttcatgcagtttgttaaattattttgaccaaatatctcatcaatccttttacaaccatttttttcatatgggacaaccaagacttcaagaactctagtaatttggcaagtacccatagtttctaagtgacacagctaggattaaatccagtttcctcttctgtacagatcatcctcctaatcactgttatatattattccaacaaaatgtgtcaatcaaagtatatgcaaaatgccaagggagcatctaggagggattatgtgattctgactgaaataactgaggaaagttttaaagaagaggcaatatctgtgctctagctcaatgctcttgatctgggccagttgtcttcaaaccctggaaactcactatgatgtgataaacacagagttcctccatagtgctttcattatgaagaaatgtaagaggtgaactggtcacctatggggataatagggaacacagccgttatcataaatactgggaaataaaaggaaagcaataatttgcacttttctatatcaaagtatcccagctaataaatgaaagaagaaatgataagactatcaacatttggcagtccttctccagcaataaattaacatgttcattctcttaaaaaaaatttgttgtttgtttgtttttgtttttgagatggagccttgctctatcgcccaggctggagtgcagtggcacaatatcagctcactgtaacctccgccttttgggttcaagttattctcctttctcagcctcctgagtagcagggattacaggttcgtgccaccacgtccagctaatttttgtatttttagtagagacggggtttcaccatgttgaccaggctggtcttgaactcctgaccttaggtgatccacccaccttggcctcccaaagtgctgggatgacaggcacaagcaaccacccccagcccaaaaaattattctaatgtgactaaagaaaagaagaagttgggataattcatgagctgcattctatacacagaatgagacaaacaattgataaataaataatatataatttaacttgtgactagtgctgcaatgaagatgcactgatagaaaatactaaggtggaggggggaaaatgaggggagggccttcttgattagagctagacaggaccaatgaaaaggcattagacatgtagagctactagaagtttccaaagcagagggaaagacaggtgtgaaagctccaaggcaaattcaggacataggaacagaaaagttttcattgaaactatattatgagaagcccataaaaaacaattggaagattgcctctattttcaggtatcttggctcattttcccttccaaatgtttacaataaagagtgctacaggtcaaatccttgactgatgttattatcagattctttgtaaaattacttaatacagaaccaacaaagatggatttgcataagcagtgatctgaatgcacgtaacatgtgaaagaataaatgctataacaggctgatcaaatatttaaggaaaataaggtttaatttagtttcaaaagccatgctacagagacagttgagatgctaattaatatcctctgtctaactccagcacacaaagcatttggaaggtctaaggttcttcttttcttaagcaatttcttcatagaggctgtccccatgccagtttttttttttttgtaccctataacttctcccagaatgacatagttaaatcccattatttgagctgccttggcagatgactcccaaactgtatgtatcccttctagatacacaccagggtggtcagcccaagtacccacaaggacataaacatttgaaggacacagtagaaaattagagtattgtggatgtcattcctcacctaaaggccttggcaattatctatttaacggatctgttttttcctgtgctggacaaataggacatagctttaagttttccttaacagcaggatgttagcatgtcacttctatcctaggttcatctagagaaggatgtaataagcatgccttcttaggggctctctgtgtctaaaatgaaattttctgattaaatgcctttctcccactgtttcccttagcttgctggttggtgtagttatccaagtactttctcccgctaaaaacttgggaaataatttggattttcctctcctctccacctgtcataccactcaaacagcaagacttactgattctataccctaaacatgtgcctgggagccaggtccttttctcctctctgttgtattccagtaaaatcactcccaaacttgtataactctgtttcactgatttgggtctttctatttcattctccagaaggccaccagcctgaatttattaaaagtctcatttcattacactgggtaaaggcttctactgagtgcagaaccagtttattcttagctttacattcaggctactttactatctggcctcaacatacctaactctaatgtgcttctttggccatcaacactcagatacttaaatggggattaatatcctttctcaaattatctgcattcctaagaccacaccctcacttgtgataccaagtgatcactatcagaggctgccattttccccaactacctcctacttatttgttcatgacccagcttaatgtcagaatatccaaggaaactcccttcacatttcaggctgataaggtcacttccctgtgctgtgaatgttctttatctgctttggcatctttctcacaggatcatgcactttgttccaaaatggaagaaactgtggactttaaactcacgcagtattggcacaaagtaggtgtttaataattatgtaaaggaatataaatcattctattataaagatacatgcacagatatgttcattgcagcactgttcacaatagcaaagacatgggatcaacccaaatgctcatcaatgatagactggataaagaaaatgtggtacatatacaccatggaatactacacagccataaaaaggaatgagatcatgtcctttacaaggagagggatagagctggaagccattatcctcagcaaactaatgcaaaaacagaaaaacaaacaccacatgttctcacttataagtgggagctgaacgatgcgaacacatggacacattggggagaacaacacagactggatcctgtcacggggagggagtacggagaggtaaagaaccaggaaaaatagccaatggatgcttggcttaattcctgggtgatgggctgatctgtgcagtaaaccaccatggtacacatttatctatgttacaaacctgcacatcctgcgcaagtactctggaacttaaacgttgaagaaaaaaaattcaaaactgcttcccgcaatgtcccctgcccccatgcctgaaaaccttgtaagattttggttctgaattggaaatcgtatttctttaagaaggcagatttcttattcctcaggaatctatatacctgctcccagaaacagtagatggtatgtcattagacagaacctcccctgagggcatccctagaatgccagaaaaatggatcaagaggagacagtaattaggagttttctaataggagaagaagaaagacaggaatctgaaacaaaacttgtttaccagggctgttgttgccactgcaaactgtgcaagaaaacaacaatgtctcaaatgctactctctaggaatggagacagtgggcagaaatggatgcttctcccaaattatggtaaatgcagagtgccaaaacgagcttctttctttctgagaatgttcttctatttgaatttaagcttataggccacggagtgcaggcaaccagcagtcggggaggccaggcacagtggcccatgcctgtagttccagcactttgggagctgaggcaggaggatctcttgagtccaggagtttcagaccagcctggacaacatagtgaggccccatccctaaaaaaattaataaataagaaaaaaaattatcattgaaagaatgagttaatgaattaatcagtgcatatatgttctccaaaatttcactcacactttaaatgttgcttttctaagtcagtatgcttcctgattttacatgtatttattcttcctacctactccttccacccccagatgcacacacacttacctatggctttcagccatttcatattagggaatttgcctcattgttgtattctatgtaacaactagcagagttgcattcctctcttaagtagtttttggtttgaaaattgcaaaagtattactgaactttggaggtgttcagaaactgtatgtcggaagagcttgaggctcctctgcatgtggtattctagtggatggggaatttttcaatgaatatacaaaatctccaaggccttctgctgtgtaaaatataaatagctgctcttgatgttcacactcattcctacacaccttcaactggtgcaagacttatcctttagagacctcctttcactagatacagttccgttacgccttttaaatgttgagtgatgacaaaataggacttattggaggggtaaatgagggatggtgacgagaacattgattttagtcccaaatagaggaagcattcaaaaattatctagtttccccaagaaatgtgcatccctaagaaatacagtgctgcggataatttccagtcagtgtctggaggatatcttcagccattagaatcataatctactattagaaacaggtattcaattttactagggaaatgtataatgtgctccacttgtgatttttctggagaggaatgtcaaatttgtattttgcctatggcagcccccacccgctttacagcatctagaaaaattgggatttaacaaggaagaaaacactagggaaaagaaatcatgtttgcactgcttaagatatggatttaaaaatatgtattttaaacaattttacttatgaagttctctgcatacatttacagagtattttctatgaaccaggaaccgagcatgtggtggatagttaggcatggtctctgcttttcaagggctcatatcttattaatatacttttgtggatgtaacagatttaatttttaatgaacataaacatagggatatcaaatttgtgttcaaaacatctaaatctcaattctctcccacaaatggctgcttctttccccagctcccctgtattagaatgctctcacctccatatcaccaaggagatttctttctggatcttgttattgataatgattttataaaaagtttttgttcaacttttattgcacttaattactgatttggtgaattcgtatacatatatattcatgtttatatattcatgcatacataattgtctataattcagcaattatgtgtatatatatatttatttatttgtataacattgactatcccatttgtaccctcaaagtaactgaaaactctattataaactccagtgcctgctctgaaagttaactgtcaagtcttagctctgcaatttctcaagagtaacataactccttctctcattcattgcatattatcttttacactgaatgaataggggaaatagcaagaaaaggagaagcactggaatgaatgcagcagccatcaggccctttattctgttcctcaagcaaagactctttctgcgagcctagggcaggtccgaaagagatggagctatctgaaccacgtggggccatttggaacaaggcttccagatgatgcagtgagctaaggtgaggcagcagtcagcttccctggtagtagaggaagttttctcagaagagatgcaagttaaacaggggtccaacaaaggaagaatgtctagtggacattttgcaaaacataaagtcagctgacagatatctggaagagcctgtgagatcttcagaagaaaggccaggttttttgttatccttgcactcatgcactggcatgaggcccagcctgaatgaaagatagaactcatttttcaagatgaaatcatctttgcatttgccttagcttgcggctggtctggcttctgagattgctgtaggtactgaggaagaaaaggaaagaattcataatcacaatcaataacagagaacgaataacttgaagtctatgatgagtcaatctgtgtatgcattcatgcattcttgcatttgtctctactaagatgaacttaaatgcccccaagagacacattcccagggactcacatcttcagcacatcaggacctcctcacatggggccacatcaagcatatgtgtggtcgcaggctgtcattccctactcaacgtctttcagggtagaaacagctccacttactccaatcatatacgtttttttgagcaacctgtctgtatcaagggcagtgtaaagagtgaagatcaaaacaataactcattcagggctgtaagaactcacagtctgatgggagagagatagcagaagactatgggtgacatgatacactcttctcctccataacaagacactagccatgggtttggaaagaagctctataaaagtggtttctgtggattttgtttgtttgtttttaagcagtatttctgcaagaggatgcatgacagagtggagtggtctgtagaaaaataagtttgagatatgcttttacttttatacatcaagttcaacatttccctctctggtaaatttttataaaatggattagcacactacaagttctcataaatcctgcagtgaagaaacctacttgttttgtttaagttaggatttaattacccccatgggcctctctttggggaatgctgctttatatcttccagacggcttccctgagttattgtgggtgcctataggcctggtgagcacagataagacctgcaatagaacccataccatcagagcacttgaggatggataaacctttggtctcattctggctaatcttctagcaagtcaagcagttaaaaaccctgaagactggccttagcagctggtcactcagcttctccttggtgggaaaactcatgctttatataataaaccaaaatctacaacttttgactgctctttttgatgttgtgttctgaagaaatctgcctacaccctcttctggagcagatttgaaagcatccctcaaatctcttgttgccaaagcttctcagaaatttgactcttcaaacccaaagccactctctagtcaaactcttctcatcctctgctcaggtggatttttaaaaaaggcactttaaatacgtttattgattgcataattagtgtggatttaacttggtcaacacaaaatcatttatcaagttcaacactgacatttttattttggtaaatcttattgaatccaacaaaaatttccatgtaatggacagcctaataaaatactcaacagttgccctgccacaactgaaggctttgttttccatagtcattctctattagtgagtgtttctctctgtttatatgttttccctagtgtttaactcaacatcatttaatcactaaattggtatcacaggtatttttctaaattaaaagccttatcatctacgttaactgcttggctactgaagagttgcttcttcctgatacaaaaaagaatagcaatataatagtaagcagttctgtccctctgtaatacctatgtgtgccagatggtggtctaggtgctgtaaacaattcaacttatacacacctcaagacaactctagaggaagatgaaattatttttcccattttataattagaaactgaaatgcagggaacttaaataactcatctagatgactcaaattagcatatctagttggagcttgaatttgaacccaagcagtcttccttcagagtccacactcgtaaggattatattatatgacttgtctcagttgaattagtacagatttgatcctagaaggcctccagtacaattgatttggctgtcaaatatttaaagaattgaagaatcacctgtgaccatgatgaatagggagaattcatgtaggtaaatattaacattagaaaatttatctgataaatgcaagaaatttagcaaaacccaggagtgatggtgtggggagcttgggtgtttgtttcccatttcacaaaacaaagcagccaaccttacattcatctcaacaagtagtttatttaacttctcagaggaagagcagcaaatgtaaataaaatcaataacagcgactgaaaaatcttaacagggaatgtatatcagctttcctctgtgtgcctctgcttgtctattttattcaagatactgaatacatgatttctcatttgggtttctgtgctgtactaggcttcagcaatatatgcatcaaacattttgaaagtctgccccaagaggcaaaaagaccatgtgaattatacattgcctcacagagtgatgatactgtagacctacttgcatgtttgtttttgaagaatttcatccaggataaaaaaagagaaatatagttgaaagggttctataggtttgacaattcaaaataaaaaaatgttatctctatggaaagtcatagtggttaagtaggattcatatctcttctatttggaatccagcatggcctcttctattgttttgtctgccagactgtgagtgtccccagatctatgatattttgcaaaagctgagttgttatcttagctgatgtctaataaccctatttatggcacagccatgttggaaataatcattagtattcttagccttgttctataaactcataatgatgtgtttcattgtttgtggtgttagccttgggctgttagacacaattctgtttacgactatgaagtcagactgtccatccagaacatgacggattatgtattcactacatctgctgaatcagctgtgtctgtgcagtgaataccacatcctcattttcagaactccatgagctttcaggtaaaaatctataagatttaccttgtaatgtatagaacacaatttatttcattttcttccgttaaatttattccttgtggtttctgttatccatagcttgtagtttgcattacaagttgaaattcctttttgtttttgctgtggtataatatccatgtgagaatcgtctttcttcatctcagatagagaaatacaaaccacccttttactcattcactgagagactgaactagcacatttttataaaactggatcaaaatgtgcttgtgatcagctgtcatcttgtggagtttccttttttttttcttgccacaattggagttctaaaccccttataataagcacatatattagatatagtcatgtgttgattcaataacctgatttcttccctcctttggctttatcacatttgtcatataactgtcaagtctccctgagtatttgcccaacatccattgagcacatggcaaggagaaaatgtggaggattttatggagatggtttgaaaggggattcccatgccttctgtccacgtttctgtggccaacagtcagtcacatgatcccacttagatgcaaggggttctatataatgtagtccctggctcaggggatgccccagagacagttctatactctaaaagaggagtatgaatccttagtagacagttttccaactgtaccactctgtgtgatcttagaagactttctgagcctgttttcttatattttaaatgaagagaacttaactaccttacagattattattattattatatgggattatatacacaaaaaacatgtgagctgaaaaatgctacacagattcattatttttataaatgatatgagtaaaatttatttatttatcttaccttaacctagagaattagaagagcgctcaggagctaggccgtattatgagtaaattgtctttgtcttcataattgtactttttcttcagagcttcttttgtgtctttatgggatgtgccaacagagcttatgaagtcaaatcttacagataagaaggaagagtctgggaaaaccaggatgattgattaccctatctacaaaccgattttgaccatttccagggtttgttgtctgtaaccattgcattaattcaatagtaaaaattatcaaccaaagacaatacctaaactaagcatcacacaaaattgtctccacaatagctttatgtagagagaaaccaatgtgcaaggtatcaatggcacctggtgtctatactatgagaatagatatagggaagatcatgcacaggttaaaagcctgatgttttgagctaaaaaaaaaaaaaaacctagtttgaacttatctgtacattaaccagttgcatagatctcggtgagttatttaacggtcttgtcttctgtttctcatttattcaacagagagaaggttaaaagcatgttgtttttattagagttgaatttgatgatgcttctaaagggttagctgcaggggaggtccactgtggggatttagccacatgcttttcatgtgtcatttttacatgtcacagaaatgctatggatatataaagttccacagtgagatagtcataaaattggaactggaactcaggactgtctgaatccaaagctctctttcataatcatattttgttccctttctgggcatggcattgtgcctggcctatggcaattgctcagtaaatcacagcagttattgttctctttcatatctgtgcccagatcaattgccagatggaagtgggtattttgttctttagtcatctatatattagacttgagcattcctcacagtgctagtggagccacaactgccccacaccctctgagatatggctctcccagaaccttcatagacaaggcataaagttgtttgctatgtactttatctgtattaacaattttacctatttgtaatgggtttgtttttctaagaagtttgaactatgagtactcccctttctaaaactggttatgaggaagaatagaacaggatataaaagaatatcttagaaacaaagaatggagaatatatgctacactcgtgttcaaacagttaaaaaaaataaaaaaatgccaaaataacttacaaaatagatcaaggagacaaaacaaaaagcccgaagtgtaaaatataatgtattattaagctagtatttacaatgaatgaggagaagatcaattacttcatatatactgcacaaccattcagataaaaaaagttagttcttcttttcatctcaaaacactcaggaaagcacccaatttcagatggaccaaacatttaaatgtttaaagtaaaactacaaaagaagcagaaaacacaggtgatatctctttgatttcagggagggaaaaagctattcaaagcaaacaaaaagttaacaatgaaatcaactatagaggcaaattgtatatttgggaagttaactgctaaaggaaatctgtacatcaaaaagcatattaaactaaattgagaggcaaatattaacctgaggaaaacatttgcaacgtactctcattgagttttcacaatattcctgtgaggtagataataatatctccatttataatgaggaaattgacagcacagacactttaagtaatttagtaatttgcccaaggtcattcagctaatgagtggagggactggaatttgaaccctcaaaaactgaactccaagcactctttacctcacacgtggctccctcgagtaagaaaacagctctagagcccagggccatgattttgtttgtttgtcccataataagcagccatttactttcagataatatatagtcatacattatttaatgatggaatatgttcttagtaacgcatcattaaatgattgtgttgtgcaaacgtcatagtgtgtacttaagcaaacatacatggtatagcctacttgcaaacctaggctatattgtatggcctgctgttcttaggacacaatcttgttactgtactgaatactataggcaattgtgacacaatggtaagtattactgtatctgaacatgtgtaaacataggaaaggaacagtaaacatataggacaaaaggtgaaaatggtaccattgtacagggcacttacatagagcttgaaggcctggaagttgctgtaggtgagtcagtgagtgagtgatgagtgaatgtgaaggcctgtttactgtacactactatggacttcataaacactgggcacttagattacactaaacttttttttttttttttttgagacggagtctcactctgtcgcccaggctggagtgcagtggcgcgatctcggctcactgcaagctccgcctcccgggttcacgccattctcctgcctcagcctcccgagtagctgggattacaggtgcccaccaccatgcccggctaattttgtttttgtatttttagtagagatggggtttcacctcgttagccaggatggtctctatctcctgacctcttgatccgcccacttctgcctcccaaagtgctgggagtacaggcgtgagccacggcacctggctagattacactaaacttattttttaaattttatctattcaataataaattaaccttagcttactgtcacattttacatttaaacttttaaattgtttcactttttgcctcttgtaatagcacttagtttaaaacacaaacacattatacagctgcccaaaaatatctgtttttatatctttattcttaagctttttactatttaaaatatttttctgtcacttttttttttttttttttttggtagagagagggcttcactttgctgcccaggatagagtgcagtggtgtgatcatggctcactcccacctcaaactccttggcttaagtgatcctcctctggctcctgagtagataggactaaaagtatgtgctacaacaactggctaatttttttttattttttaacttattattattgttattatttggtagagaaagggtctccctgtgttgcccaggctggtatcgaactcctaagctcaagcaatcctcccttcttggcatcccaaattgctgggattacaggtgtcttttactttttaaaactttttgttagaaagtaagacaaaaacacacacactagtctaggcctactcagggtcagaatcatcaatgcatcactaggtaatagaaatttttcagctccattgtaatcttatgggaccaccatcatatatgccagttcctttttcactgaaatgttattatatggtgcatgactgtaattttgggatttctactctgattttttctaactagagtaaaagaaagttcaatatttaatacatagaaacaaaattgtgacattaaaaaaacaaataaaacaactccctagaaatatagagctgccattagaaacgctgcagcaagcctcattgtctcctgagtaccgggcctgacactcggcctgccccaggtctggccatgtctaagtgctgaggaaggaagcctttctctagagttttggtccacgccagcatccttttgcagttctcctctgtagcctgcattttcaggatgcttccatactacggaatgtattatttcctctccttggaatgcctgcgatcatcataggtatctaggaaaccatttttcaaagtgctagacagtattaggatatctttgaagtcaccctagagctacgtaatcattcctaataataaaataaaaacttccatgcatctgtgatgccactcacactagataataattttatgttcatttgccttattcctctattaagctggtctattattaagcctccaatttgtctgttagaccaatgatgcccaacctttttggcaccagggaccagttttgtggaagacaatttttttccacagacaggtggtaggggaatagggggaatacggtttcaggatgaaactgttccacctcaaatcatcaggtattagattctcataaggaacacatagcctagatccctcacatgtgcagttcacaatagggttcgcgctcctttgagaatctgatgctgttgctgatctgacaggaggtggagctcaggtggtaatgctcgcttacccacctctcacctcctgctctgtggcctggttcctaacaggccatggaccagcagcagtccatggcctggagattggggacccctgtgttagacaatctctgtgtctcctgaatccagcatagctaggaacataggaggagctgcatgatacctggtgagctgaaccaaactccacggtgaaacaacagtgctctgtgtttattctccaatgtgttcatttgagttccatatcataattcagcacacactgggagcacagaagatcccctgaccagcatcagcctgtagggacctgaatgtcagtgaaggttaccgctgccttgtggaaaaggcactgatcactggaatggaaagttcaggacaaatttggcagtgataaactcaacccctctgttctccctgggctgatttttccgctaagaaaatcttaaggagggtctagcacccactgtggggttaccatttttaaagagcttgatgcacgtcaaaaagagcatgtaatttgggtttgaaagaaaggaagacaagaaaggcacagaccgtggtgtgtgtgtttgggtgggtggggtgtgctggaagacagggcagtctgccactgggcctcaggccctgagagcctgggagagtccactgtgtttctccaggatcttccctgactcagttccagacaggctcttcacaaagactcctcagttcatcacatgattcccaacccaaccaggggacagctgtccatgcttgtgctgatggtctagctggacaaagaaaatgggtgaaccagggtatataagttccttggaggactgagagatgtagaaactcttctaagaagagtgtttccctctttggctttgtaatcttattgcattatctttattatcaatgacaaacagagcatccactctgttccagacattttcagaggtgccagggtacaaagatgaactccatcctgaggaactggtcacatctgtctatagggaattcagtctatttgtgtgccagaagagcataaagacactgacaaaaagaaaagtcattaaggggccggcttctggaagagagatgtcactggagaatgaagtagaaaaaggctggagaaactggaaccaaaggcaacagggaccaagacctcgctctgtctctcaagaaggacacaaagaacagtgattatagtgtacaccttggagtaagatagacctgggtttaagtccctactgtgatatttctaaattccaaagcctacacccaacctcatgcagcatcagttttctaatctgaaaaagggaagaaagaatatgtatcatcgttgggttaaaagagttgaatactcacataaagcatgctcacatagtgtactcacaggctcacctgaggtagcattccccatgcctcagtgacttgtgggtagaaatgaaggcttactaatattcatgctcagaattttcagctgcattgcctccactggaggaaacagaaggtcatcagcctcctgcattgagtctctccattcactggcagtttctcttagattgatacagtctgcttgccacactgtagccagagcagtttgctccatcaccatggcagggctgctaccaaataggccttcttgtccatactcctgtaccatacctttaggtcactggggccactgtagaatcaaagcactttgtttagttcttggcatgctctattacctgcatactaccgtgagccacatcttccatcaccctgtttggttctcaccattctgccatgtctgtgagcctttaccttgcattgctgtgcattgctgtaggctgagggccctgcacctacttcaggtttctctacagagttgcactggtttctaattgttgctgttactaccaccattgttagtgttatcagcagacttttttgactgatcggattggattgtaagcaagtgcaagtatatgtattcattcattcaaaaaccacccactgagcaactattgcatgttaaatattatttcagacaaggaggatgcaatagtgagcacagctgacccaatccctgacctcattcagaagtttatagtctagaaacatatcttctctcccatctttctgccggagaaaagaaaaacagtgctgctctgtcctgtgttgaattatttctcaacatctctgcatcatcctttaaatgtagtctgtgctcctcccgtctgagccctccaacagcatccacttgatcccagagaaaggaagtaatattcacctaaaaataacaagcatatcaacctcagcttctgccagccatgattccctgggaataccatttctttcaggagctggaacacagaaaatatcagcagaagttaccccaaattgttgagcccccttggttccagtcagaatatttttcaagaaaaaagataattctacttcatttgctcattgctctggttgtcaggagtatgatacggaatacaaaagacaaagaatcagtttggaaactgctagaggaattgagtaatggcaaggtcatgattctctttattttgatagctggtggggaatttgcttcttgcctctccctaactggagtgaggattgcatctttctccgctttttgctgcctacacaatctcactttctttacaagcccgttccattacattctctttctccatccctttgccatttttcttatgtgtaaaacaggaataatagccatactgacatcaagatatgttttgaggactgagttggtacattgggttatggaaacatgtccacagtagagcgcttaagggttgtgcggctaaggctttggagtttggcttcctggcttcgttatttgctttgacttcccttaggcaaattttaacctctctttgtaaaataaagaaactgatagctacttaaaagttgtagttatgacttacaaatcatgtctacaaagcatgtagcacagtgtcccacatagtaagtagtgaatataactagctactaaatttatgatgaatattattatatctttcttttcctccctttacctcaagagtgctacttaatttgctctgttttgatctctgtctttcatgcaactctctattcatttcggtgcaggaaaaaactgagatgagaatgacataaaatctggagacagtgcaggctttctggcttctcttcttagctacacgtgcagcagggttatggcagtgcagggaatcagcagatagggtctctggctgagcaagaagttccaagggagcacagatatgacactgcagggggcctgttctcaggggtctgcagtccctgtgtgaccctgctagagccttgcaccagcagctgcagtgtgaggagcacctccccaagaagagccctctatcctcccacatgcctgctctttgagcaatagtcatctgttcaggacgtatgcattatttccttctccatttgtcatatggattgcctaatatttatctgtgctgtttttcacattactctgaaaggtttctaagttatacttctttatgtgctcttggattgctggcttacaccaccactgccaccaccatcaacaataccacgactgctaccaccgtcaacaatatcagcactaccgccaccatcaacaatactactgctgccaccaccatcaaaatcatcaccattaccaccatgaacaccctcacaaataccattatgatcagtatcaccaccactatcatcaacaccatcaccaccacaatcaccaccattaacaccattaccaccatcaacaccaccaccaccaccaccactgccaccaccaccatcgacaccatcacaaataccattgtgacaactatcatcattgctatcatcaacaccatcaccaccaccaccaccatcaccaccaccaccattaacaccatcaccaccagcacccaccattaccaccacttccactgtgtgtcaagcttcctctcctctgggacattttttctgtttctggctcagacttgcacatccctcctatttgctttttctgtttccacattcttatcattgcacatgtcacacccactaactgattttggattgaatcctataaaatacagctcatgtagatttatccatttgaaattgcttaaatttgaccgtttttgactgtttgcttatttcacatattcaagctggtatttatctacgcaccccattaaactgttagttacgtgagaaaacaaggagaacttttactctattttggcaacacctggcacagtgcttgatacttgatacaggtgcattgaataactgaatgaggcatatggcataagctttatagactctgaagcagtattcaaatgtaagagactgctgcagtaaaacaattgagcatataaaaatattttcatattaggccgggtgcagtggctcacacctgtaatcccagcattttgggaggctgaggtgggtggatcacctgaggtctggagttcgagaccagcctggccaacatggagaaaccccgtctctactaaaaatacaaaaattagccagacatggtggcacatgcctgtaatcccagctactcgggaggctgaggcaggacaatcgtttgaacccgggaggcggaggtggcggtgagctgagatcacaccattgcattccagcctggacaacaagagtgaaactccatctcaaaataaataaataaataaataaatctatctatctatctatcttcatattaaaaatgtgacctgtccttagaggttgatttggaaatgaagaaaagaaaagtgtgagactttgaatcatagaagttcaaatatattccagagttctcagggtaagtcaggggcagccttgggggatgagtaggtagggtcccattttcttcttctgtctctgctgctctacctttatttgtttgtatattaatgatccaaatatacatatacacatatatatatatatttatattactcataagaaatttaaaaattctgcaatagatgtcatggagccaataaaggacttcaggcagggaaatgtcctgttgagattagtaattttgggatgtaatttttgtttggggcaggagcatcagtgatggggtgaagagattgaagctggaggcccaagggtcagtgaggagatgggagctgagaagaggagatgggctggacaggaagctaggaatattcatctcactggaggatgcggggactgagaggggaagtctgccttgatcccaagattgggggtgattagggggctatgtggatagcagtgccattctcagagacaggtgctgtaagaatagttttggggagaaagatagtaaatctgatttgagtttattgagtgggagatatgactatacaagtctaaaattgatcttgcaaagtgggtaggctgataactgtcttttttattttttcctattttgttgatgtgaaaactgtggctcacagaggttgcttgaatgaccaaaatagaaaagagccagggagatatagggctggtcttgaacccaagatgactacattctttaatctcttcattatctgtccacctactagaaagtcatattggaagtgatggatgccagctccccaggcgttcctggcctccttaggattggatgtatccagaaactgactagtgagcagcgcttttaatattttaattaatcattaactggcttgccctctgagcactttttgctcctgctttgaatttttagacagatggcaggcggttatttcctcagctttgtcatctttcacatggcagatgaaatatcaagcacagacttggagaaggatcataattcattataattagtcttctttgatcatttgtcctttgtcctaagtacagtagcaacatttaattgtggctgaagcattagtcaagagcagtgagcaaaatgctctctctctctctgtcttctctcaatatatgcctgagggcaccactgatgttgggaaaccatattctcagttggctttttaaatagctatacagcagcaagtggaaggggcgttgtatttagaagccatgacatgaatatggcctattttccttgatcatgttagtattgttaattaacatactgaccatttagtactgttgtgaggatttaggaaggaaaggagctaactaacattaactgatggcctcctctgtgcttgataatttactgatatgctctcactacctcttcagaacatgtcaaggctggataactgggcaaagtcatgcagctaccacatggcagagaaccaacccctcaactgcctgaatccagaacctatgcatttgtacaagcttgtttatctgcactctcttgtagtgtatttacttaacaagccaagttagattgtaatcgaaagcaggtgctgtcatatcactgcatgaatcttgaaaagcatggctctgagaggtgacactgagagtggcagttgctggataatgtgttgttacaaattaacttcttgccctgccaattaaaaagcactttattgaataaagtaatgatgctcttttatgcctgttgtgtgatttagattttagtagtcaatataattgtatgacttagctttcagtctttacactcacttacccaagtcttatgaatcaggtggggaaatgaaattagttccattttacagatcagagaattgaggctcagttggtgccactgctattgaaggtcagctagcttttaaataatcagactgtagacatgtagattcatgtggcctctcctaaataagatccaagcagtagcaaaaatatgaagacttaggctcaggaaaattttttcttagaagctgacattcagctccaagtcatatggttagggtttgcttctttccacttttcaatttctgacactaagtgataattatagagactgagaagcaccgagtgcatttgctgaagctaattgactcgatggggggaaggctgattgtgcagcggaatccaaactaccaattaaagaagaaggaaatcacatgcacatgatatcttggatatttatatcttggggaactaaaagagccagccttccttgccaccgtggagacagtctgagagtcaaagtgcccggccctggggtggtcagcttgaggcctgggtttggccaagaccgcagccagcagcaccctggtcagcagcttctcagcccctaatgagtgctctggaggctgtgcttctaggctaaaatgggaaatcttggcaaaggaagagattagattcaatgcacaatgagagaggaaatcaggcaaataggagctgcatcaatcaattaattatcagaaaaagggggctcagaatacactaataatgctaacttgtgtacagtgctttggagtttacagagtatatggctctctcaacagcagccacttaagaagcaggagtgtttcccccagcttccagcaggcaagtgcatgccctgcttcccaaatctcctgggcaagaggagctaggccaggaatgcaggcttctgacttatggtcatagctgccgagggctgcctgcattgatgggtcctgggggtggtagtagggagtagacttggtgtggtttgtagctgattctcccaggaactggtttttgtttgtttgtttctaaattctatcttactgaagagcatccctacagtggcacaccagagtggctgcaaggctaacgataatggggctattaactaaataacggtgctggcacaaagaaacagccatgctaggatcttaattaggctctggctgaagcagagatggagcacatttgcaagagatttctggttgactaatctggtgtcaaattaagagtgttctctctgggttgtctcaagtcagtcaccgtatgacttaaaaagttgtctaaacgaagaattccaagtgggccaatttctcaggagaagagaggacttgcttccccaagagctagctccctggaatagattagcaccaggatccctttgtcttcgttgactaacagtttaactttacaggcttctcagctgggagtccactgtttctgtcccactaataagggctgaagtctgtccggctgtgtacctgggttactagagctgaaaagcacttggcagtcctggatgggctgtttatgagtagttcttctatctgcagcagcagttaaatggttctgggaaatgaatcaggatcaaaggggagcttgaggccagggcccagaacctgggctcttagggggtggggggcagcagaacagaacaaagtagtagggaaagcatgatgtcacacggaccttgtatctcacgtgacctctgctcttcccactggttgtggggtagagccatcatgttaattctgctgggcctttttcaatacctttaaaatgggcttattcatttctatgtcatgtaagagtcatgaagtttggatgaggttagagtttatgactctagccagggacacagtaaatactcagggaacagtcgttgcttctggatctatccagcttctttagaggcctgatgtctctatcaggatgtgccttgtgattgcccaggcactcatgcctgtttagattgaggtcccaaccctcctgacttcattggctctgcccagtggtgcactcccttgacctcctctattcttgccgtcacttccaggcacctgtgtctggcttttctcttcagtgaataattcaaatcctatcatcctctgactattcctcctcttctcctccaacctctgtctcttctacttggtacagcaactctgactgcccttggaataacaccctccccagctcaaccactgcctgccagagtcatgaactctagaagcagattccaccaggctttcttccccaaaaagaatatgcatcacaagaggcacttgagtagggagaggggatctctgaagcaatgccctaacccccttctttggctttttgatggattatgttgggtggaaatcaacttcaacatccatcttctagtggaagctgactcctctgattgccactagggagataggggcttaatgaaacagaattattggactaggaaagtataggccttgaaatcgacctgcttctaaaggtaaacaggtaggcagttcaggccaggaagctggaagaagactggtaaataagcaggatgctgcctgaagaacccatgcagaaaggtgatgaatggagatccagcaggcaggtggggtcagcgactctggaaataaggacacagcattaacggtcaggccagtacccaagaaattagacagacatgtgctgctgagaatagggtgaatggaagcagagtctagatcctcaggttaaataaacgatggtcacaggaggaacatggcatagcctggaaggaggggcacacacgatgaggaggtgaggacaggcaaggggaaggggaaggggtattatgctgggtttcaggatttggggccctagtaccctgaccaaaaaaaaaaaaaaacaaaacatattggccatacatttttaagcaggcgaaggcgggtggacagggatccacaaagagcttcaaggatgtgcaagctggtaattccacagactgactttgcagagattctatcaacttatttaaataggggaccgttattgaatttttacctgttccccagcagatagaatcaaatgagacagcatgtgaaggagccctgtaaacagtcaagcactgcactttattgacaagtttatcctttatagaactgctggtgttctgtgagcccattattgtactcactaaatattagctactcaaacatttgctattatgatgtggcagggaaaattgtgaagtattaatttacatttatgcatttcctcttgcccttatccaaaaaggtagcaggctctgggcttcctggcctgcaatacacttctgttcctcattttatctcttccacgctgccaaactcatggtgaatatttaagaggcagaggccctctcagggaaacaagtaaaaatgggatatgttttcctttgatctgaagacaatttgcagtcctggaaaaggaaggaaggattttgaatcctgctgaagagggaacttgtgctctattccctggtagcagaccaggaaggtggcctgctttcagagagagaagactgtgaatccacaccaaggggccccaggaccctaagctgctggacaggaagggaacaagaggacaggaatagtagggcactcactggtgacttgtgacgatggatgtcctgtgactgatgagctaaggcattcatgctaccaaacagctctgggccttctaccactctgagacttaggggcatggtagaggaagggatttaagctcagtcataagtatatttgattttctttcctccttggtagagaaggatatatcatattaaatttaacttgattttaaggaaacgagtaatatggcctttgtgcccatattcatgttgtgtgtgtgtgtatgtgtgtgtgtgtgtattttgaaggtcatatattttgcataactgttatatgatcacatatctcctaagggaaatggaaaacatttgcccagcacctgctatatatgcccctgtttctagcacatcactaaggcaatcaatttgagacttcagaataacctatgaagtattagtgtcctctttatatagataagaaactgagttaaataatgtttaagtgattctgcactaggataggtggttagtgttagaactaggatttaaacccaggtcatgtgatcccaaagctcaacctccctccaccacatcacgctggattccccaagaaggaggaggttagcagtgatgctcctcccttgcatgagaagggtgggcgcctatggcaggaggtttaataactatgaactgtgatataaaataattctcttgaatttatatggaagtgtcagacctttagaggaagtgtcagaccttcagagggggcactgctgagaggctgaatcattgaggtggatgagattacatatgagagaccttcaatgtgacccagatctgttttattttaaaaaacagttatcactgtcctcaccaccatctccctgctgaccaccacctttttaaatctcagcattgaggagagatttctatggatacattggcattgtccaggagacaggtgacacaaaaagacctgacagatttctcctaggcagagaattatgtgaggagggtgttgaattacatctaggaatagaatagtctgctggcgctgcagctacagggaaatgcctcactgaatatcagcaggcactttagatctattgcatctaatggaatcttcagtgtgatttaaagaagtagatattctgatttgattcctgttattttggtggtcatggggaaggatggggagtgatattgagaggagagagagagagaaagaaagggaaggagggaggaagggagaaagaaaaagaatctttgtatttaaatcagtgacaatgggagaaaaaaacaaacaacattcctgatttcttgctatcattgagcataaatatcattatttaactcttatagctcagaaagataagctcccagtcagctaggttttagcttctttgtgaaatgaatgagctcccctgaagctcatcacatgcattcctaaataagtttgtaagggaactacagttattcacttggcctgttgagttcttttcattttgcttttcgaaaatggttcttaagtgaaaagacacatgtttattgcctccttcattctttccctccccttttccctcccttccttccgctttccttcaatttccccctgcttcttttcctgctatgaacacttattgaatgcttgtgtttacaaagcgttgagacaagtacaagggagatagtaatggtcagacacaaagagctcctggtgcactctgtaaagaaacccagatctgtagaaagttaaagaaggacccatggagcaagaggcatatcaaacagaacttaaaggtgagtggcacttcaggagacagagatgcctcttagtggtggtggtggtggtggtcatggtggcgtggtgttgggggaaaggttctgatgaggaatgtgcatgagaaaactgacaaagacgtacagttcagggagtgatcatggctaggccatggtggctagaataggagtgggtatgcatggcatatcagggaccaattgtgaaggtggagagccagcctctgagtacctaggagccaagctattcctctgggtacctggccttgccgaagatttctgagtacataggaagcctggcctgcatgggcatgcagacatgagctctgtgtgtctgaatgcacattagtacaagatgtttacttgatgttgcatttcagattagatggtgaaaatgaatggatattatcattattatttccttctaattacttccttagttaaggtcaaaatagagccagagatgatcattttttcccttgcatctttgaatgtgcatgctaagaaacgcaatgtagtggcaagctaatcgctttcatcccatctcacctagtcaattgtacaaaaaacttgccgtgtttctacttttccagactgtagaagagggaagtgctgggggcctctgtgtgtgctgctgtcaggtgggagccctccctctggcctctttataacctgtttctgagatgcagagctcaaatccaatgccatgtcaaggcacactgtaaaagaagggctttgggtttctgagctcccgtctaaacagatctctatttattgggattaattgatcattaatatttgcagtaaagatatctttcagtgagagtcaagaaacttggtagaaatcgctgaggccttgaagccagatagaggtagatgaaagatctgtcctcactactcatgctgtgggtaacttcacacaagtggctgaaaccctctaggcttcaattttctcctctcttgagaatgtattataaggataatatgagacggaatgtgtaaaacacattataagtactcaataaaagagaacgataattatttaacagtgttagctacagggacagaaatcatggagagttcaatagtactttgttaagactggaaagattctgcaccctcacaatagagttcgtcagaggcccatgactgcctaatggcactttgcaaagaaagctgataagctggaggcaggttccagcagtgcccagaactcagccaggttaaacagcaatgctgtgtctcagtgacaaacctcagtgtcctctggcaatggtcacatttgctgttagctccagctctggttgctgtcctgcctgggttcagctcagcaatccttttgcccactgttgtttccagaaacaagtctcagctccatttcccagaaacagtccttagttgaagtgagagcttccaaccctgcctcctcaagctcccctgccctactcagccttatcagggacctctgtttatacagctaacctgccccattccccagtctgctgtccacacaattccctggttctcccaggggcctggttctgcggctgtctttcttttttgatggtccctgcacctctctgtgcaagagctgacagagactccaggctcctctgtggtcctcttgttgctggactttttccttagttcagctaaaaacgggatccttgtcacatgaccatgaaagattaggcacacagacacttcgaagggtgagaagggcaggctttattggatgaaaaggggaaaaagggaaatagtgactctcagcaaagcaagagtcctgcaagtagacttcctacctcacagattgaaacccatttgaccaccctggaactcgagaggccaggcgcctctcccctacaaacggtccgaacttcccacggctccaccccattctcccagtgtgcaggcctgttggaggctctctggggatctctttaaacttggctgtctcactctctgttacctggttgcctgctggctgtcaacccacctgaactattgagagatcatgggacattctgaaggcatttcttaatgttcctcctctggcccagtttaaatgacatcttctctgcaaactatattacataaagcttttttattttaacctataggcttactttttctcaaagaaaaattgtaacataacttcagggaaaattaaaactgaaagaattctattcgtaatcaaggtttgcgactgggcacggtggctcatgcctgtaatcccagcactttgggagcccgaggcaggcagatcacaagttcaagacctgcctggccaacatggtgaaaccccgtctctactaaaaatacaaaaatgtggcaggcacctataatcccagctactcctgaggctgaggcaggagaatcacttgaacccaggaggcagaggttgcagtgagctgagatggtgccattgcactccagcctgggctacaagagcaagactccatctcgaaaaaaaaaaaaatcaaggtttgtatatttcttaaagtttggagccaaattataattgattcattcagcaaataaccaagcatctactgtgagggactgtgtatgagccaagtaggataaattacttaatatgagtggatggtggagataaatcatacttgaaattgaaaaaaaaaaatactagaacaaatcctgtctcttgctcctatgtaaccataatcctttaatcttcaaattaaccatggtcaaattcttaatatcttttaccacctataaaaagattggtcagtctttgaaaaattaaacagacatttgggtcccagagcctggggcattgaacacattttattcgaaataggttttgtatggatgtgtgcctattccatgtagaagcagacatagcgagatggagatacagcaaggaagccccttaaaatacactagttcaatgatgagaaatgcactttctgcaaaaacagcttcacaggtatataagtgacagttcggagtcctttgattggtgtttttgaaaagagagattgagattaagagaatttgtgctgatttccaatagctcttctaccttaaaatattttttatgacagaggctacttattacaatattttcaaatgggttatcaagcatcgccgttttatggcaattccccttcgggtatccctgtccaaataatgtgcatttctacttgactaattcatttaggaggacaacagacacctcaggggagacatttaaagtctttcttcagaaggactcccatgtgtggtaatgagagcatgttttccccttttctttcttctcttccattatctcagataacaggaattaattagtgtcctacagtcttttactttaaactccactttaagagactcatctactaagtgactttgttgttttattattttgttttgatttttcttattcttgaaaacaccagggctgcttctagaatttcttgaataagccaagccaacaataggcacaatgctgccttttctgtgggtaaatacccactcttcactaagggaaggggtgtggtgcagacattgtaggaaagtggtgctcattttccttctgagctgatgcacagtgcctgctgcagtttctaaaaacagcctgctaacataacaatataccaacttcaggaaaattagtgtgggctttctgtgaacacacccagttgttgacacactttctaaagcaatcctgtgattgtacagtcatggtgctagacagtgtgatgtctgtgcgcaccagcttgcttttctgcagtgttcactctatcaagctaaaatggagtgcctattcagaaccacgcactgagctgtgtgttttagtgggtgaagaaaggaactgctctttgccctttagaaatttagagggtgactagagttataaagtaaggaagaaataaatggattatagaccaaatgcagccagcgtcatggagaggtatagtaaatgtattaggggtgacaaaaattgtttttcagtttaaaagagtcaacagactggtgtcagcaagatttcccccatggcaacatgaaaacaaacaaacaaaccaacaaacaaacaaaaccagcaactagaaacggactaaaataactttgtagggactcggaaattggcaaaggtatacagcaaccaaataaacacccaatcatggaaaagccacattcaaaatgatggggagctttgtggcattttcacttgccattgcccctttgccttcccagtgtcgttcagcacagtatgagggagttggtggcccagtcctcagctcccttcggtgaactgaagattgcagagaactgagtttgcaacatcctaacttgtcttcaggctgcttgaggtgtcactaactcagtgtataaaagagcaaaactagatttgaccgcagtctgaaggaagccatgggaagcagtggtgatgcctcatgaaaactgcaaggagctacaaacgtgaagacccctgagacaagagattgcctgctgaggaatacaattgaacagctaaggcccagaggagaagtaggggtgtgactcttagataaaataagacatttaaaaactatcatgtatatgaagaattgggggaaaaaatgatgcattcacaggaccaggaatatacatgttcagaacagtccctcaagccttaagagaggactttaaggctttatgtcataccgatgagtgaatgccttcttctgcatggactatgtgcagagactggagaggtgtctgtgtctgttttttgcaagtactctattttctatgagagatcagagatatacaaagaaatatgaatgcatggtccattcaaaggaaaaaacaaaatccccagaaatagtctctgaagaaatataggcactgagcttactagataaagacttttaaatagctgacttaaattttctcaaggagctaaagaaaaacatgaatggatgactaaaataaatcaggaatattatatatgaacaaaatgagaatatcaacaaagagataatatattttaaaaagaagtaaacaaattatggagctaaaacatacaataacaactgaaaatttcactagaagggttcaacagcagatttgaagaaacagaagaactaatcatagaacttgaagacaagtcatttgacattattgaatctgaaaaagaaaaaggaaaaatgaatgaagaaaagtgaatggagcctcagggatgtgtgggccattaccaaggggaccaatgtatgtactacaggagtccaagaaagagaagcaggagagaaagaggaagatatcttatttaaagaaataatgactgaaaacatactaaatttaggaaagaaatgaatatacaaatacaagaagctcagtgaactccaaataggataaattcagagagagtgtacctatattaagacaaattataataaaagtattgaattcaaagacaaagaaagcatcttgaaagcagcaagagaaaagccaggtatgataattccttctaagattatcagcatatttctcttgagaaacactgcaggccagagggcagcgggatggtgtatttaatgtgccgaaagaaaaaaaaaaggaagaaaaaaaacttatcaaccaagatcttaaatccacagcctagctttatactttaaaaacctcgaaaaacagcaagaaaaagctagcagaaagaaataacaaagattggagcagatagacacaaaatagagaacagaaaaagaatagaaaaaatatatataaatgaaacaatgagttggttcattgaaattttaaataaaattgaccaacctttagctagattaactatgattgagagaaaagactcaactaaattcagaaatgaaagagggaaaaatactaacaccaattttattgaaatacaaataattataagacagtattataaacaatataaccaacaaattggataatctaggggaaatggccaaattcctaaaaacatacaacctactaagactgaatcataaagacatagaaaatctgaatggacatataattatccaagacattgcatcagtaatgaaggagctcctgagaaagaaaagcccaggaacagatggcttcatgggtgaatagaatagaaagccaagaagtaaacttttacatatatggttaaatgcttttctacaaagataccaaaaccattaaatgagaaaataacagtcttttcaaaaaattatattggaaaaattggatattcacatgcaaaaaaattaagttagacccttatcttacactataaaacaattaactgaaagtggatcaaatacttaaatgtaaatttaaaatgctaaaaatattagaagaaatacaggggaaaagcttcatgacattggatctggcaatgatcttttggaaatgacatcaaagccataagcaacagcaacaagaaacataaattgaactacatcaaaattaaaaactttcatgcattaaagaatgttatcaatagagtgaaaaggcaacccatggaatgggagaaaacatttgaaaattacacatctgataagcagttaaggtccaaaatatatagagttcctacaacttgacaattaaaaaacaacttgatttaaaaaaagagcaaatgacttgaatagacatttctccaaagaaaatatccaaatggccaataagcacatgaaaagaaattcaacatcaacaatcactagggcaaggcaaatcaaaagcatgaaaacatagtccctcacagtcatgaggatggctaatatgaaaaacaaagcaaaacagacaaaacaacaaaacaaaaaacaagttttggtgagaatgtggagaaatgacatccttgtgcactgctggtaaggatgtaaaatggtgcagccactgtggaatagtatgtcagttcctcaaaaaattaaaaataaaactactttatgatccagcaatttcacttgtaggtatatactcgaaataattgaaagcagggacttcaagagatattgatacactcatgttcatagcagcagtattcataatagccaaaggtgaagtcaatccaagagtcctttgatggatgaatacatgaacaaaatatggtatatatacacaatggaatattgttcagccttaaaaaggaagaaaattcgaacacatgctacagcatgaatgcatcttgaagacattatgctaagtaaaacaaacctgtccaaaaaggtcaaatactgaatggctctccttatatgaggtaccaaaagtaatcaaattcatagagacaaagagtggaatgttggttgccaagggatgtgtatagagggaaatggggagttattgtttgacagttacagatattcagtttgggatgatgaaaaagttctggaaatgatactgataatggtcacacaacaatgtacttaataccactgaagagtatacttaaaaatggttaaataagaaatttaacataatgtatattatactacaataaaaaatagtaaagttttttgaaaagaatcaaaataagccttatggaataaatgtcatttgacacgtgagttccgagttcatccagttaattcatccagactttcccttttggaaaggatggatgacaagtctggcactacttctgggccagggtgaacagcagaatctgagtataaaaccacatgtgaactagtgctgcagaagctgatgttcaaaaaggtccataaaatcaaaagagaggccaagtgtggggattccatatggagaaccatgaggactgatggcaaagatccccagaatgcaccaggagaataagaaggagaacaagaacctcaactgtgacctgagacatgggaataccaaatccacacaaggagttaagggaggaaatgtcaagtagggtctcacgagcagagttgggttccagaagaaagaacatgaccaacgcagtgagatgagaaataggtttattgagatacataataataataatgccaacatagaccactaagggctttaatgtatatgagcacagggacccattaactggattgtattattatcccttttgccattggtaattttcctattatgtgtccgagcaagtatttgaacccaaagacctcagagcccatgcccttgaccacttatgctatagagagagaattagctgagtataacacaaaacatgaagtcatttgaatcacattttaaagggctgaccttcagatggtggcatttactgggccttgtggaaccttgatgttttttagcaggcaagagatgagaacagaaattactctgggaagacaatttggcaacacagaaatgaaataatttgatgaatgtcaaggctgaaattagggagatcagttagggaacatagaggaataaggcataaaccgaggggacaggaatggaatgtgtggactcaaaaacctttgaggaagttgaatcaagtggatttagctactaattagctgaacagtgccaagactccgggagagtctgcaatgactctgggacatctgaaactatggtgaggccaagtgtgcaatgatgtaagcagggataaggaaaacgggactactctgtggtggttggaattaattgtcagaaatccccaatcaaatcccctctgggatttgaagaatacatttttaagatgcataattagtctgaaagtaataacatgaatcctaaaatgcttacgaatccctttactaccatggatactaagctctttaatagggcacaagaacctctgttaactgggtgagatttaggagttcagcaatcacaagacagctccagctatttgagattatgctgagtgttggcttgtgtcactcttttttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatcggaaaggtggggaaaagattgagaaatccgatggcttgtgtcactcttgaaaattactttgaagtcttttagacttatcctattatatccttttatatgccacgccagttgaaacttggaaataattaaaaacaatagacaagaacctgctaatcttttatggtattcttctatttaggaaataattgattgggcgaagtggattacatttcaatattcagacaggctccttttgttattacttttgactctatctgctttttaaattaccttgcctattttgaaagcacagtacagttttcttatgtttctctttttggtgcaagacaatgtagaaaggctcatggtgtaaaggtgaaggatatccactatccaatttaatatccttacatgactaacatttttagagaaatagtcctttgaaattaataggaggtgatgtgacagtggaaaaaaatgtaaaaatcaatcagacttgattttcaatactggtgctggcacttaagagctttgggattttggaaattgaattaaataattgatcctcaatttctttgtctgaaatataggaataaaaatacctttaactcagggttattatgaggtttggtacatacgtatatttatatgtaactatatgtatacacacagacatacacatcacacctatagacagagaggaaggggggaagagaggatatgcacgcgtgtgtagtcttggcacatagtaaaaaaactggccgggcgcggtggctcatgcctgtaatcccagcaccttgggagacagaggtgggcggatcacctgaggtcaggagttggagggaaaaaaaaaaaaacagctgggcgtggtgatgcatgcctgtaatccccagctacttgggagtctgaggcaggagaatcgcttgaacccgggaggcagaggttgcggtgagccgaggtcgcgccattgcactccagcatggacaacaagagcaaaactctgtctcaaaaaaaaaaaaaaaaaaaaaagcccggcaccggggctcatgcctgtaatcccagcacgttgggaggccgaggcgggcggatcacgaggtcaggagattgagaccatcctggctaacatggtaaaactccgtctctactaaaaacacaaaaaaattagcggggcgtggtggtgggcgcctgcagtcccagctacttggaaggctgaggcaggagaatggcgtgaacctggagcgcggagtttgcagtgagccgagatggcgccactgcactccagcctgggctacagagcgagactgcgtctcaaaaacaaaaacaaaaacaaaaacaaacaaaaaaaccttaccatttaaaaaacgtgttctgtcctgccctaagaaagaatgcctaatgtttttgaggttcatctgctatgataaatgaaagaagccaaactcgaaagattgcgtattgcaggatttcattcataagaaaggtcaaaaattcacaaatttaattaggacacaaagtagattagtggttgtctaggattgggtagtggggttgataatggcaatttacaagtataaggtttattttctttttgcagtgggaaatatcttaacattagatttgtggtaatggttgcaccactctgtaaatgtactaataatcattgaattgcacacattcaacaggtgatgtttaagctatagtaattacatcaccaaaaagtcattttaaaataaaaaggatgatatttctgtatactaagctgactatcctaagtaaaataattggtgcttatgaaaaaaagaaacattatttgtgctttggggttaaggaagtctctcctgtatttgtctttaaatatttctttttgtgtgttgaccatttttttggtaataactccccaaatcagagtggtatatgagaatcattttctcatttacattacatattggcatctattcaggtctgtttgtgttttgccagccccactctgctctgattagctctggtccacacgtattcatacagcccgtgcatggcacatgcttattctcatggcacaagagaaaactaagccaaacctattagcacttaaagcttctgcacagatataccctgtttcatagctgcttccgtgtcattggctaacgcagctcacatggtcaagcctagtgctgatggaagtaaacttgcacttctaccatggagtgaggggattatgaatatttctgaacaataatacaatgagacaatctaccagtgttggaggacgatttggctaacatcctgacttgagcttaatcctctatcagtgcttcccatcccttctactctcttactatccaaagtatatctcatcttcctcttttcccactgggatttactgtaaacccttttctcctccaccatgaaaaactctgccaaggagcttgctgtcattcccagctaccatctcatgccttccatttcttgtactgccagacttcacaattatgaccaattggtgtccttactatttctctatcatacattgtttttatttctctatcatatttaactgcgttatgacttgaaacttctcaatccattggatttactctttctaaagcctctaatggccttagttgccaaatccatgacatttcttcagccattatttattttgatggtagtcatatttgtaccgtgaactcataaagtgcagcgtgtctgatcccccttatttgccaggttccacattcttctcccccacacttccttcctgtgtgatctggtatagtcccaggttttactttctgagagtgtgactcccatattaacatgtttatttctggctttcttaagtaagaaattaaagggtcaaaatgattactctatttaattaatcattcatttacatattaacattgctaatctgtttttgaacaggatggaaacagaaaacacttctctgggaaatttaaaggtaatcttaggtttaataattctattcataaatattactgtatgtagttgaaattagttcacaaattataaattacaattctaggccgggcacgatggctcacacctttaattttagcactttgggaggccgaggcaggcggatcacttgaggtcaggagttcaaaaccagcctggctaacatggtaaaaacgcatctctactaaaaacacaaaaaagtgagccaggcatggtggtgggtgcctgtaatcttagctactttggaggctgagacaggagaactgtttgaacccgggaggcagaagttgcagtgagctgagatcacgccactgcacttcaggctgggcagtagagtgagactccatctcaaaaagaaaaaattacaattctgtagtagaaatacagtattatgtttcgaagcacagcttagctcaatgcctgtatctagtgatttttctctccatttttaaaaccaaacatatacaaataggaaatattagggattatacgtgtagaattagatgtgctctgtgaaaaaaaaaatccacatgtagaattatgcaaaatacttgggcaaatgtaaatataccacaactgtttttattaaatcactatttttagttatcatgttgtctttatgagcattgagcacacttagtagaaaggctgccacactgtgtttagccttgtcatcctggaacaagatttttcatcttgaatagtctgataccaagactgaacccatctactgcaaagacctgtgttctgggaacgcaaagaatattctgacccccttttccagtattgagctgaaatcacaaagattttgtggtatagtgataagagctgtaagatttgggtttctattcctggcactaaccttggagtacggggacttgggagaggtgtggtgtagggaaacaggcaaggtcagtgctacacagagtgtgattcttggataggcaccatcaaagggaccacggagcttggtagaaatacgcatttctaggtttcacccagacccacccagacctgctatatcagagtcttagggttgagggccagccgcctattataaccagctatcttgatgtttcaagtgcttattaaagtttaggaagcacagggatagtcatctctacttaggcaatgaggttttgttaatcttcatagaggtgcaattatgggaggaaaatggtagtgagtaggagattgtggttgataatgatgtacctacaggattacagtgtgggggcaaatgagagagagtcataaatacagagtctgagtgaaccaaaatgagccttggagggagtaaatcttactgtagacaagcatcaagtttaccaaccagcacagatcctacaatcttgcaaggatgcaagaattttcttaaatgggttaacaagtaacttcagttcaaaaaattccaacattcaaagtttctgtccaggaaaggcagggcagatgggcccaaacagatgaaaaaaagtaatttgatgtgggggatttctaggaatatatgcactccctacttgtccatgcagaaccttattcagagaccagcctggcctttgctagagaactggacttcaaaattgaaagggactaacacaatgatgatgcttttattatggaaaagaaaacatgatttgcatacagagtcaggtgagtgcagtggtgactgggtctcccagatggaggccagctcttccttctgccctttaaagggtccagcaacttctgactttgagctctcaaagcagcttccttgcttggtcatctcaaactccgtggacctttgtagaactgagaaaataatctggctttcaaatggtaattcttgtatgttttcataaagatgttggtgatgatgacatgatgttgctgatgatgtaaagtaggcaatgctagtagtagatgtagtaggtgtttcccctctgtttaatgtagatggcttcccagaaaattgcaatgtagcttttcacatttcacacacaaacacacacacgccaggccctattccccttttaaaaaggttttcctctctgtcactaacggagatttcctagaatcacaacttgggttggaaaggagggacatcaccagttgctcaagtttagttcatgggaaataatctctggctaccccagcacctgagcgtcctggtggatttcatgactgtatgcattgctcttgatttgcctgctagtgtatgggcacaaacaagggtttggaatttagaaatggcaacaaatctgccttttaactcttatgactacttctaagaaaattaaagaaaatgctatatgcattagattttaatttgcttttcatattcagagaccatctggaaatgtaattatagttcaaacttttaatctccagtgcctagacaagctttttaaaattgtatttgaatctgtaaacagacacgctggttttttctataatggcttatttgttttgcaataaaacagtgtaatgatttaaaacagggtcgcatacctgcccattcccacctggactgacacttagaatctgggatacatatggatatttagtgaatgagccaaatccctgtttttcattcctgacttttaagtacactttgtgtactacagtgggtgagacgttaagtttcagaattaatctaagatggttctgaacccaggtatcaccacattttggctttgtgtccttggccaaaagatttaacctcactgagccttggtcttattttttgtaaaataggagattataatagctttgtccttgggtttgttctgaagactaaatgagatgatatatgtaaagaatttagtactgtgcctggcacaagtcaacaataacagttttgttgtcattactgttattgttttaaagttgtagctactatttattgttattttattttaaaaaattcttgtctgtttgtcccttacataagctatctttggcattaattacatctacaaattcccagttgtcacttgatctgatttgctttacttccaatcacagtggtccctgctctttagcatgcagggctacatttgtcagtgattaccttatgaaataccctggtgcaaagccagaatttaatatgaagatcttgtcaggagagctacattcctagtacagtcacaatgttggcaaagaatatagttggactagaggactttttagatctttccaggtctgagatctgggacttccagagtctctaatctccgtaaagagaacagtaatgtcttgtcccatttctgtatgcaagagtgatgtatgtgattctgccagctttttccagaatactcactactagtgactaacactttttagtgttaaccatctaaaagattgggaataatgtcagtttgcatacctataaagtaaaaatgataccatgggaagggtatgctgcagtatgaacaagataatatgtttatagcacccttcacaatacaccttgctccatgctagcacggttagacattgtctctggaatgctactgtgatacttgttcattacgaccccagtgtagggctcaggaacttaactacacaactgtgtccccactataaccctgctctaaccaaatagtcttacaagcctccaatgccctgactgaattcaaagatgagctgatttttagataaacttgcaaaggaatataaccttaaatgatctcctatttataatttataaaacacacttatacaaattgataatgatgtatgtttgaataattcaagaaacaggatgtcaatagattttagcaccaagtaccaagaaagcttctgcttgtgaatattaatttgactaatttgagatattaggccatctagtatggtaagcatatttgcagagtagtaggattttcgaagggtaatctaatcagaaatgggccaactagcatttgtaaaaaatgtaacaattacctgaagatctcatatgagatattttgcaactggcaaagagcaagataccctaagtaaaatgtaactgagcaccaaattaaatattgggaaaatgtctggaaagaatccatagtaagttgctttgttttgtactgtgctttcctcctatttatacaaatacatttatagatgagtatagacatttatagtctgagtagtttcatttatatgaccacaaaagtacaggcagcaaaagcaaaaaaaaataggctggtgaggcttctgtacagaaaaagaaacagttaagggagttaaaggattacctatggagcaggagaaaatattaactgctctatatctaataaggactcaatatctaaaaatgtaagaaacttctacaactcaataacaaaaaagtaataataacccaattaaaaaatggaagtggacttgaatagacatttcttcaaagaatgcatacaaatgtcccacagatacatgaaaaggtgttcaacatcactaatcgtcagggaaacgcaagtcaaaaccaaaatgaaatatcatctcacacttctgagcatggccattatcaaagaaacaaactagcagaaaataacaagtgttggagagaggatgtggagaaattggaacccttgtatattattggtgggactgtaaaatagtgcagctactactgaaaacagtatgaatgttcctcaaaaaactgaaaatcaaaataattgaaatcagtttttcaaagagatatttgtactcccatattcaatgaagcattattcatagtagtcaagaggtagaaaaagcctaaatgtccattggcaggtgaatggacaaagaaattgttgctcatgcctataatggatttttttttttttgagatggagtcttgctctgtcgcccaggctggagtgcagtggtgcaatcttggctcactgcaacctctgtctcccgggttgaagcaattcttctgcctcagcctcccaagtagctgggattacaggcatgtgccaccccacctggctaattttggtatttttagtagagaagggtttcaccatgttggcgaggctggtctcgaactcctgacctcgtgatctgcccacctcagcctcccaaagtgctgggattacaggcgtgagccaccacacccggccacaatggataccatgagatatcattcagccataagaatggaggaaattctgtcaaatgctataacatggatcaactttgagggcattatgttaagtgaaataagccagtcacagaaggacaaatgctatatgattccacttataggagatctctaaatcagccgaacccacagaagcagaaagtggaatggtacttgctagggcctgggaagggctgatcagagtatagagtttcagtcatgtaagttgtaaagttataaagatcttctgtaaaccattgtgcttatagttaacaatactgtactgaacacaaaagtttaagaggtttaacataatggttattatatatgtataatatatgtatatataatacactatatatatctattatatagatatatctattatatagatatatatataatttttcatcatcaatgtgctaaatcctgaggatacaaagaataaaagtatattttgctttgttcttgtaacataaacctatatataaataaacagaaattgtaagtcagtataaaagccagatacttcatcgtcctgcaagtatgtaaatgcattttaaaatgaacaccttagaaaggggattgtggattcagtttccagtgactaatttatgtctacattgggaggaatgtgtaagtctaatacacgctttctatcattgttttattttaatcctccacacaaacttgggtaacactattctgtgaaccacctgagggaccagctttgtaaccctgagtggaggttaatatatattaaaaaatagtgttataatgagtgcactccagtctccagaatccaggttaaacatgtcatcatgaccagaggccattgctaattttactttcatgtgaatctctttttaggcttcacatctagttgggattatttagaaatgaccaagactacaattattatacacagtttattagaaaaagaaaaggcatttgcctttatgttattgatttatttacttgtgttagttttaagaaaagacaaacagatcagatatagaaacacagcaatgctattttctatcaaattcctctgggtgtctcatgaaaatcttgcatattgaattttaaatccaattcgtgcagcccagaatgacatttcagtatattatgagttgtagtcaatatattgattacagtctctttgggcttacaatgattaaagaccatcacatggatacagtatttgtttagcagacaattctcaagattttcatgtgtgatacagaagccctaacaattatattgtatgtgtgccaaatgtttttcaaggctattgaaaataagaaaatttaattaaaatggtgtgaattcatttaaatttgtatggagagaatgggagatataattatgagcctgttcttggttgtttattgcatgaagttggctacttggtaatttcaagaccatggtaaaccagggttattttgaagtcatcaacaagtcatccttggaaagaacttccaattcttaagcaccttatacctgcctggtatgctaaacatacaaactcatttactcttcacagccatcttccacagaaatgttattatttccaaatgtggaaactgagacttctagaggacacgtagtttgccaaaggccacacaaatccagtagggctgaacttagaatgaggcctccaaaactgcaagtaaaatttaaataaatacaaaataacttactttgattaaatctggactacattgagaaagcccttgttttgtttttatcacacagctctcataaaattattattattttttaattgcaaagtatgctaagtacaaaatggtagctccaactttagtctgaataactacaatctccactgagggatttctttccaacaacagtgttccatggaagcagagatgacttttgtggtctcaagtggacttggccctcaaaggggaagctgcctctgagggtggggttattcactccaactctgggggctgtgaagccatctccagggatggcatgaccagttgggtcttgaatggagagttacataaaacctcaggaattaatgatttaataccatattctgtatttattttcttattttttcatgaagatcttcataccatagggtctcaaatatttaggaaaaaaaatgtttggattaaaccttctatcacattactcttgccttgaattgtgaatttttaaaaatgaaatttcagttgggatcacttttgtgtccagttacctaatatatatataggcctaatcaataataaacatgactactatttatgcataccaggtgctctgctaggagcttttgtttaattagcccagtacactcacacagcccatatgagactagtattgtaaaccacatatacagatgagataatgggggtttagaaaagctcattagcttgcctaaattcaccaactagtgtgattaaaattggatgtgaatgcagagctagttgattcggaaatgggtgctttaataatactattcagttcctatattttttaacatatccccacatagtgtattaacatgttcttagagatatatggagaaggaaaattcacctaaaaatctataccagggaacagttagcaatctttgtttaggttcatctgaagtttctgtaggcagttttctggaataagcttctctatggctggtattgcatcagcagcagtttcaatagggcagtctctgtgtctagagctcaagaaaatcagagcctgggtcatggtaggtaggcaaaggctgaggcagcaatgtcactcttaggagggaagcaataacctaagccaaataaatggtcatagtacaccctcaacctaaggtattgtcacaaacagggggctggagcctggattcattcatcaaagagcatgcctgttgattgtgcagaaggcatccattttagagaatttggatctttgagacatggtagagcaaacaaaacaaatgacatttatttcacacttgatatatgccagacattatgccaggcaattcatttgcacaactttattgtattcttatcaaaatctattgaaaaaagtattgttatctcatttcaagatgaagatgctaggacttaaaaaaaagtttttggatcaacattatacagctactaagcaagatactacgatataaaccctttctgtgcatctttccacagcccagtgctgttttcctggagattgctactgaaagtcattttcaacctcatacctggaaagatagggaagccaaggcacagagaagatgaatgatttctctgaggtcataaaactattaagtgccagaaccaggttttactgccagtctatttgatttcaaaattatttcaattagatcattgccatctctatgttaatatatcgttaatccttaagaaaactgtcatctgacccaaactcccacaccagcagccaacttgcttctttgcttctgttgctgcaaaactcttttaagatgtatctacactcaggttggcagttcctctacttctggcagccagttcctctacttctgttctcctaactttttcagattgcttttcccctctcatgctcatacagaagtcatccggatcccatactgctcaatcgatgaccaattcccagtcttgggtgatctatcagcaaggccatcttgcccttctattgggtaaactttgttcaaatggctcctagtgtcatatatactcagtctttctcctaccttgctgaacaccctttcttacttctctccaagctcttcacacaggagcatcttttttttgatgctcttgtctcttgctttctcctcatgactttggtgaatttatcccatgttcataactctatgtatcacctacatttcaacaacattaaaaattatagcttcagctgagacctgctttccaaactctagacttgtatttgcaaatgtctaccttatatccctatttggctgtctaacagatatttaagacaatatctccagtacttgattcctattcttccctcaaaacctgcttcaccagctgcctctctcatctcaagaatctgcatctttctcattattgctactgttaacacactgatccaaaccattatcatttcttgtctggattatttaaaataaataataaaaaactaaatatttaatgggatttcctacttcaaactcagttcatctagggtctgttttcaatatggcagccaatatggcagcgtgaccaaaatgtgtcccgttatgtcattcccattctcaaaaatgacctcaccatctgactcagaaacagttgaaacatttacaatggtcttcttctgagctcctctctctttctctacacccatcataccatcacattccagctgtaggatgttggctgtagaattttgcactggttgagttgccctatccccagatatcagctttaataactacctcatccttttcaagtctttgtccatgttttacactctcagtaatccctactctgaactatctaacgaagtaaactgcctgccatcttattttgtcctcctgattctgcctatgctgttcccataaaatatatatatatatatatatataaaataaagatgcatcgctttctaacactctagataatgtgtttatttagcatggatattgcttattgttggttttctcccctagaatgtaaataccacaagggcataaatttggtctttttaccactagtgtattttgagcacttaaaacagtgcctgagacataataggtcctcaaaaaatacttgttgaatgagataataaaagtaagtatattgcagaccttttttagccatcttaactttgcagaaatttaagtatctaatctgaagtatctgagggtacatttttcccctcataatctctgctatttaactagtgtctaatttcctaccaattagtctatgtaaatttatttcaggcttcatataaaccactgagcagctcaatgatattgatctttactgccatttaatggggttggtcagtgatcaactccaggcaagaccctgaatcagcttttacttatctgccctctggcatgtaaataagtggacaaatgtctgcaaactcatgagacccttcctcttttccttaaatgttgtcatatgcctatctgtgctctttctttggttagaaaaataaagggaatttaaaatctttggaataacaggaagaactagaatcattcataagtattttcttcaactttactctaattgccctaagattaatctcttgttacaacagcaaagtctagcctctctagaattccttgaacactgtatttcaataatttgatcctcatggacagtgaatctatctgtcacagtcagttgtcctttcactctttgaatcaattggcgtttacccatatcaaactctatttgtccatcacttctaaaactcttgataatttccaattgctcatggagctgagcttgaaggttgacatggatcatccattctttccagaatgacaaatagcattacatggtgatcctcacattttatcttaatttcttggcaaatgttaatttaattttctgctaaatggtttcaatctcatgcagaaccaaagtgaactaagttaactatctcagaaatatcccctgtcttgtcaggataattatttctttcatttaaatgaaaattaagtaacactctctggtgatttttttagatcatcaacataatttctgatgtcactgtgaacctctgagacacgttaagcttaaatttccccctaggctcaaagtggttatatgaatttacttgttcaaaagagattgcatagaaacctaacacaaactgacggcatcttggagctaaaagtagtcttaggtattatgaaacccagtcataacagagtttgcaagtagagaaactgaagctcagaaaggaaagttgaatgtataagttcacattgcaccaaattgggcagagacgaatagcaaaccttggtcttttgacttagtccaataaagctataaaattacatgcaaatgttggtgaatatttgcagaacatttgtttgagaaacgtgtccttagcaatttatcacaaaggtcagtgatctctctaatgttaggcaccaaggtccacttcactattttacagacacagttggcccagggtccatgtaaagttaatccaagaatccatgtaaaactaaattgagctttgtattcagttttaaacaatagtaacttctttcttactaatgagcatggatggattagttgggtatccctgctggggcattggattgctgtgacttcagtgctctctggaacaagcgcagtccaggtgcctgtgtgtggagaagataaaacacttgatgttcaggtttgtttttttttttaatttcaatttttattttaagttctgaggtacatgtctaggatgtgcaggtttgttacataggtaaatgtgtgccatggtggtttgctgcacctatcaacccatcacttaggtgttaagcccaggatacactagctatttttcctaatgctctccctaccctgacctaaccccctaacaggccccagttcgtgttgttcctctccctgtgtctatgtgttctcattgttcagctcctacttataagtgaggacatgcgatgtttggttttctgtttctgtgttagtttgctgaggataatggctttcagctccatccatgtccctgtaaaggacaagatcttgttcctttttatggctgcatagtattccatggtgtatatgtaccacattttctttatccagtctatcactgatggacatttgggttaattctgtgtctttgctgttgtgaatagtgctgcaatgaacatacatgtccatgtatctttgtaacagagtaatttatattcctctaggtatatacctagaagaaaatataggaaataccattcaggacatagggatgggcaaagatttcatgatgaaagtgccaaaagcaattgcagcaaaagcaaaaattgacaaatgggatctcattacattaagtagcttctgcacagcaaaagaaactatcatcagaggaaacaggcaacctacagagtgggagaccatttctgcattctattcatctgacaaacatctaatatccagaatctacacggaacttaaacttacaacaaaaaacagccccattaaaaagtgggcaaaagacatgaacaaacacttctcaaaagaagacactcatgaagccaataaacatatgacaaaaagttcaacatcactgattattagagaaatgcaaatcaaaaccacaatgaaataccatctcacaccagtcagaatggcgattattaaaaactcaaggtacaacacatgctggcaaagttgcagagaaataggaatgcttttacactattggagggaatgtaaattagttcaaccattgtggaagacagtgtggcgattcctcaaggatctagaaccagaaatatcatttgacccagcactcccattactgaagttcagtatttctaaacagagaagataattagttttttatcttctgttgacttctacctctcctccgcaaagatttcaattagtaaaaataaaagctaacacacacataggtaagaaaactcaaatacgatctccttttgcaaaatttttattatgagattttgaaataataggacgtgtgatgatatgtaaattccttccactatagcttttgaggttgtgtgtgtatgtgtaagtgcgaatgtgtgtgtgtgtgtgtgtatggatttgcgtgagaattagatattaacattaaaaaacttatttttccatcatatatcagaaaacatgatttttaataaatgtatcatctaatatgcaaagatgtattacaagaaaaaaattaatatgcctgctttgccactaaatccatcacccccaggcattctcattctcccttctaaagcccatttttcatctgtaagtgaaagaattgaactagtttgctaagaccctttgttaataatcagtgtgtatgtggtgacttgctactaaactcaaactgcaggtcacctccaccattttctgagacagaaattgtatgagcagtttttttgcgtgattgaaaataatatatgcatgtgagacattggcagctaagaacttggctattatatgcatatcagacaccgtgataggctgatcctactctttcttttttctttttttttttaatttttgagacagtgtcttgctctgtcacccaggctgcaatgcagtggcacgatctccactcactgcaacctccacctcccgggttcaagcaattctcctgcctcagcctcccgagtagctgagattacaggtgcgggccaccacacccagctaatttttgtatttttaatagagatggggtttcatcatgccaggctagtttcaaactcctgacctcgtgatctgcccgtctcggcctcccaaagtgctgggattacaggcgtgagccactgcgccaggccgatccctgctctttcttaatcatagctttgaacagttgtagtcccaaggctatccctcttatggttttaaagttgacccttctggcattataataagttatgcactctaggatttttcattgagaaaagactaagaattgattttaatctcagatcttacagttcagcaaacagctttttcctacttgattttttttttgtcccatatccctttcccatgcatttctcttttgctcttctctcccttccatttacccaactaggtctcacatctcagaatcagatgtaatagatttttgtgtttccacctagtactgttttcccagagtaatctgggaaagttgggcacgcctagcagacaacatagactttgtggaatatccttcttccacaacttaaagggtcttctttacaaaattacaaatctttacaaaattacagttaaaaggtcttagcagaagccctaagaaagtgggagcccaaagggtaagcctcatcaaattcctggtaaatccatatatgtccatctctgtctggctgtgtctacttttgtatgttccaatgttttagagtgcagacacacacacacacacacacacacacacacaaagatgcaaaatgctggtgtcctgccactttctctttggcagaatgtgagactaaaaacattctcagtgagttcttgcctaaagaatgtaggactattttgaaggctccagaggacaattaataagattttatttttctttttattagaatttacatttattgacgttcataaagaagctgataactgcttagaatatgaactcagatatggtctctctgacaagatgccctcctgcacaaaatgttggcattagcattatgcatgcaattgatgtgatatattcagaattactctgaaagaaaagaagaaaatgttaaggagactgatacattcaaacaattttaggtttgtaacatggttgttagcgataaaatttgaagaagaattaagggtgagagaaaaagtaattggcctccagtaaacacctctcactgccagtacaaggcaaggagacaaggtcagcattcatatttcataagcctagtaataacaccactgtaatctgcacagctactttggatgtgagatgatattctatttctgggggagtcagcttttctttatgtacagtatctctcttttcccatttaaaaattatttccattcattaaaaaagagataaaagaattacaaaactacctcccttgttcccagaactctctattgacatgattgtttatttctctttctgcctttaatgtctttataagtatttatttaacttatttgagaatatattgtctatgttttatcctgttttattctctttacatatttctatgctaacattcctcattgtaaacagcctttttgcagatgtttaccttaaatatcaaacaccaaatatcaaagtttactaaacttttcctcccattgttaaatatctagattaattccaaattttcttcattaaacatacattgccgtgaatattttctatctaatcagtttctttattttagattacattcttagaatatattcccagaagtagaattagagactccaaggatttgaatcttttaaaaagtgtttttaatacatggttccaaatctcataccaaatggaatacattgattttcatatttaatatctaaatttgtgaaatattctgctgaattaactttgatttttttcccgtcagtctttaattaaaagttgctgtctctctcagttacaggactagctaccagatttgaactgactgccagtcattctgggtaaaagcgtcaggtttttcttaactctgttgagtatatatcctattcaaaaaactgagttttttgtggggcaaataattagcatgaaatgcaagttggctctcttcatccttctcgttaaatcttgcataccatcttaaaatacttgaacttttctttttaatccataataggcaaaataaatactcaaattagcaaacaaaaatcaaaataacagtctttataaaagaatagtatttcaccatgattaacattttcatgtgtggtgcacacttatacaaaatgagtttttgaaaattttattattcccctgcagccctccagcccagaataatcaccattctactctctacttctcttcagcttttttagatttcacgtataagtaagatcataaaatatttgtctttctgtgtttggcttatttcactcagcataatgtcctccaaggtcatccatattgttacaaatggcagaatcttcttctttttaaaagctgaatagtactttagtgtgtgtgtatgtgtgtgtgtgtgtgcgcataaaatagaaccacactttcatgactcattcatccatcagtggacagttggatcatttccatatcttggttattgtgaataatgttacagtgaacatgtgggtacagcaatttcttccagatggtgatttcattttctttggatatatacccagaagtgagattgctggacaacatggtagttctattttcaatttttaggagcactcatactgctttttcataatggctataccagttctccccaccaacgatagacaagggttcctttttcttcacattctcaccaacacttgttgcctcttgtctttttcatgatagccatcctaacagttttgagatgatactgtggttttgatttgcatatctctgctgactagtgatgttgcacatcttttcctatatctgttgatcacttgtatgtattctttggaaaaaaatgtctgttcaggttctttgctcattttttaattgagttatttggtttttttttttctaatgacttgtgtcagtttttaaaatgtattagatattaatccttcatcagatatatggtttgcatatatattctcttattttatagcttatcttttcatttcattgattgtttgctgtgaaaaaaaatccatcattaaggggaaataaacaagggtgatttttttctcactttgtgttgatttttttttgagacataatttgagttgtacatcactaattagaattgagataaaaagatggaagaaagccacttccacagcacgttttatatgaactcgcaggaagcagaagtatgcagaagttagaagaggcaccttgagctcaaaatgaaaaaattctgtcttttaaacatcactgcttgtcttcatcagaaaccaaatgtgacttcttggtagggatgttgtaaaggggtttaccattggtgggtagatgaattccatgaatttaaaattgcttttcacctttgaaatttagtgagttcattacagctgggaggcagacctatgggattcataaatggctgagaagaaaaggacatgagattactaggagaaaatacactctgatggaagagagagtcactcccaaccgttggctcaggagtaagctttagttgtcgatgaagaggagtggtttagagaattgcctgttgcctgtcactcaatgttgcctcaacccaggtattcatatggcactgtgggggttcttgagaaagcataagcaaaaacttacagaatttttttcggtaaaatcctgtaagccattaaggtacacagtgtattatgcagtaaatttaggtcacccatttcatggcccacagctcagtttgggaagcttgtagactccagatgagactccagggcatcaacaagaaagcatgatgaaagcattgaccaagaaaggtggaaacatattgagtagcaggaaccaaagcccatttgaaaaggaaatgccattagacactggtggttctcagtggaaacacaaagatgccttgagaagaagagtctggcctagtgacaagtgaggagtactgaattcagctggaaaaagaattctcttttttaggcaaactccataccacttgaggcaaagagccaacatgtattccctacaatctgagctgtaactcagtttgcttttgttttttcaaacagttaaaaagagacttggctggtactttcaaaggggaaattgagataactaacaattttggagaaggaatattgcattttcaggttcatttactatgaatgcctaccaaagcaattacagacaaacctttctttctttcctagaagataataaaaatgataattagcaatctgctccttcatttcttcacatgttcttgaccttgccttgctatttagggcttaccatatacagatgatttttagaaagaatatgatttaatttcttttagaaattaaatttctaacatttagaagcttcgttttcttaaatataaatgttttttcaaatggtctcaaatggtctctaagcaaaaaataggacaatagaaaagacctctgttgctactgtttcttacattctgggaagttatataagctgaatatgtgtgaattgaatgatatatctttaaaatatttattggttaggtataagttataaatcacccataatagtttagttaaatttattttacttttatgattatatacagggcaaactagagactttgaggtgtgaaaaaccttcaggtaaattctcactccacggtgtacaggctaagcctcagcttgaaagttgtgataatctaacaaagagttcttgtgaaggttaaatagaatgaagactagaaaacatcttgtacaaaactctctgatttcaagtagccttcattgtgagtataaagctgagacaaatgaccttgaaaactatatatgaataagggctaaagtgtcagtccaggctgtagttgcttgagaaggacaagaaaataaggcagccatcagagcagtgaggacatattgaaaaaggagaggcatatgctagaacttggaggaggatagggatgtagtaggtcatctctgagcccctacataagtcctgaagtctctatttgatgcttagaatgaccattaccctgaaatcttacaattagcctcttagtttcttcctagggaacatttaatgattactggctccattaagtgttgcattaagccagaaattcagtgaaaccatattaatcacataaacgtaaaaaccagaattagcctctgagctactttgttcctcagtgtccccattgcatatacttggcaagtccacccaaacctatctctttaatatccatgggatccgtccatttctctccatgttaacttccatgactacatttaatactacctttttgtaggttgaattatttcagcagtttcaattgccatccttgcttccgctgcagtgcattgttcatacaaacagcagctagatcattctaacttgcatctgatctgctaaaatcctttcagtgggtctttagaatctttgtcctttggcaataaggaggaagcagtagaacaagcttgtgtctgttctaaacagtgactatgctgctttgggtaggaatcactggatttatagttggcctatactgaacttttggttctatgtgtctaaggggtactcatcttacatatgaaaaatgatctttccagttgaaaaatgatgttatgtataaacctgtggaaaaacatgagagtgtcctaaactcgggtatcaacaataagcctagtaaaatggtatcaagtttaaaggtctagatggtagatggttatttaatgagaggtaaggatggagtatgatttagatttataggtagacaattgggggtataatgtcgttaaataagatagggaaaagaatatgctgaactttgctaagagggaaaattaataaatttaatttgaacatattgtgtctgggatatctctacctccagatagaggggcttggttgtaggctattgttgcaaactatatggagctggtgagagggatccaagctggaggcagatttggaagagatcaggacattggtgatgtgagaaggaacagatgggaatgggtggaaatctaagcacggccaagtaagaaagaagtggactggagatagagctgccatctattgtccacactgtgcattcacctcctactatgaccctagtgcttctgcctatgtcctcccttaggatattttcagcaccgcaacaagagcaaaccttttaacatagaagttaggtcacctcactcccctgtctgaaacctgccaagggctccctgttacactcaggtcaaaagtcaacatactttcaaggttccgcaggccctccatgacctgccagccccttccccatgggctttctggtctcttattttaaactctcctggccccttcattccatggtcccttcgttccattcccaagtgttatctggcttacttatctgccaatataccggggagcctcttgccttagcccttctcagtggcaaggctattctctctaaaatattattttcccagaaagtaccatgtctttctctctttcctctctcagatctgtgcttaaaggttgaccatgcatcaagtgttggttgaccatattttagtaactcaattctctaaccaccaaaaatgggactttttagttctatgttctgctttatcttactccatagctgatattattaatatttttatcctgcatatttcattatttatttgcgcattgtctctcccaatcaaagtgttagcttaatgagggtaaggattgtgtctcttctgttcactgctgtgttcatgacaccccaaacactgcctggcacataacataggagccgctcagtgaatgattgctgaaggactgaatcaagatggggatgaatgaaatccgaagagatccagtgtcttaagtcataggcagcagagagagggttcatttgaatgctatgggtgagataagcatatgtcaagaaatatcttggcaggagttgacataactctgattgctttctctaaaaaaattagggttttttttgtttgtttttttgtgttttattagcaatctaaaagtctctagagtgagcttgccaggttctggagtcctgttcctcatgtactaacacacactgatgtgtgaatggtaggcttgtgtgaacctgttcaggtcagcagtatccttcccttgctctgatcattttagactcaataaaaaaatcagtttagcagcacaacttcccaggttttcttggtgtttgtgttttccctcagatacattgtaaaaggctttattgcaggggcaaagtactttccttcttctcataccttccagtgctaagcacctaaataaagagcaattgaaattttattaattaaatattaattgcatttttctgatatttcaatgaaaacttctaagaaaaggtgattatatttctatattttggcaagaacactggaaccgaagtcaggaaatataaactggagtctcctgtcacctactttttaagtgagtgactttcgaagagttacaaatttctttgtgcctcagtttcctcctatattaattgtaataattatcagtcctgccttaaatcacactagtatggaatttaacaaggtaatttaaaaattattttctataacataaaactttatgaatttcatttatataactgtctgtggagaaactacttttccctaggatttctttgtagatcctctgaatcagacaattctaggtcttagtatgtgaaatgcacatattttagatagtcgacttatttaaaatgttattctgtttctggatttgcattcttttgccttccaatttgatttgtctgatatgttgtgaagagtatatgactaaatgattataaggtatttctggagttattaaacggtgcttcttgtctcaatggaaataacagtttcattttgtagcttatccattttgactagaagaaagcccagaagtgaatcagggtgtgtctatattttgtacctcctaattgattttcaaaatgatataagtgaaacagaagcgaagggaagattgaaatttacaagctgtgtaaatatttccccatagaaataagcttatgaactttagaagagggtgagggagagatgcattttagaggcatgaccaaaatgaatactgaaagatcagacccacatggactgaatcattagcttggagatctcaggaaaatctggtgagtagaatcttctgagagaaggaactttggtagtagaaagtagggtgtaaatccactgatttcaagaagatgtaagagttttacctccacttggtaaggcatgtatatctgaagtcagtttctgtctgctatggactgacttgaggattgactactcaatcaacatatatctataaaatatcatgcactaggcaaattgtgggcactgtggtgaagaaagcttatgacagtagatctcacggggccctcaatctatttagaaaggtagtttccaggccaataatttaaatagtttttgagtgtagggcagaacactgtgggatactacaactttggccagtaaggacacctaacctggtttggaagctcaggaaagattatatcaaacccagtactaaacatttaatatcccaaattccagggtttacacaacctcatacacagtcatactacttatgagaccagtgctttcatttgcatgcagtcaagctatggaatgttgttcagtcactacacttcatgcttttgaactaatgtagtggggtgtactttaaaggaggcagacggcctggacaacagctgtgtataaggtaatctttgaatgtcatctgttaaatggaaaaaaaatgccactcttacttctcagtttgctctgaatatgcactgaaatactgcctgtagaagatgaaccaaagctgacacttattaatgttaggtctgattttctgagccattgattgtgacattatagtaagctcttgtctgtggatttggtttgtggtcttgattcaccttgcagaagggacgggtttctataactctgtgcccttcatgaatgatcagtcagatgccttctaatggggcactcattgagtactgtcttgtgtttgcagcctgaatgttcttgtgttgggaagagccataccagaatctttcagataaagcaatgggacacattgtcatgtatcacactgttatcaacacatctataagtggcccttttcctcagcatagcattttttttcctgggtattatggatgagtttcccatgctgtggtgtagccaaagttgtcctattaaggaaagtcacagcactttggatggtaaggcatgataatgcaattctgaaggggattcttaatgtacggatgatcaaaaggtgaccctaagggcaaattgataattgtgggaagcccagtgcttcccaccagtgtacagagataggttaatttatatttccccacaggtgtttgtctgatagactaatgatgttaagcagaataacaaaatctgcatttaaatgaatgtattataatgtggaaaagtaagcccaaatacaaagtaagcgccatcacgtttgggataaaaacaaagtacagtatcattagagtcctctgggaaaacgtttgtctgtgatttatggtcttattttggagcggctcttatagaccctcctggaacccagctaatgaataaatgataattctacccctctatacatcacacttttttttacttttttttttgttactacagcataaacacacattcccattagattaatgtttctaataaattaggaaaaatgctaagtaagaaagaaagggaaccaaaatggaaaattcagtgaagtacagactctatgggccaagagataatttacttttattagttttttctttaagaccatagtgaaagtaatgatctagctatttttattttaaatattgcacagataattttggaatcgaaagtggaaccaattatttaaagtcctaccctcgtcttccctgagacttaaatagaaacagtagggaaatgcaaagtatttaactggtatgaaactgagagcaactaatcagaaagaatgtcaggcataatacaagagtagaaagaatcctagctgttcactgatgtgccatgtgttaactctttagtctttgaatagcgggaagatctgaggacctagagaaagggccagagtagccacaggggtggtcatgtggcatccagagaacctgtagctatttaccaactgattgagaagtatttcagtgttttaacaactggtatcactgtacatgccagtggactgtgagccctgaagagatagaccattgagttctattttcttgtcaaattgggccacaggaagtctcaggctcattgagatctagttagggctctgtcactcactagctgttgacgtttgtgtaagtcagtgcacaatcaccccagtccctttctccccctttgcagtgatatggagctactactacctacttggtaaggctggtagatgcatatgactagataattgcatgggatactgcaatgcaaagtctgaagcatgatacctgtctaactgtggagaacccctgattttgctttgtccgggattctttttccaacctcactttgaagaacccctgaaggcactgaacatctagatatcctacatcctgtggccaaggggcaggcagaaaacctaagctcatgcaaatttatactatctcctaacaattgtatttttaagaagagtgctacaaggatttttaatggttaaaatttatttatcttgagacaagtgccattaagagactgtgcaagggccaggcgcgtggctcacgcctgtaatcccagcactttgggaggccgaggcaggcggaccacaatgtcaggagactgagaccatcctggctaacacggaaaaaccccttctctactaaaaatgcaaaaaaactagcgaggcatggtggcacgtgcctgtaaccccagctactcgggagactgaggcaagagaatcacttgaacgtgggaggcagaggttgcagtgagtcgagattgcgccactgcactccagcctaagccatagagcgagactctgtctcaaacaaagaacaacaacaaaacaagagactttgcgaggaatgttgcaagctgtcccagtgctgccttgatgcctcttcagacaaggtactccaacttttcctttgattccttataagtaatttcttccaacaagttactcttttgcttaaatctgacacatcaagttttgttgcctgcagtcacagaaactttttgtagagaagtggccccttagttttcaaagaaacacaaatgccactgcttggggctttcctctatctgcttggaatttcttcttccttccctctctcccttcctccttttcctctcttactccctcttttcctgcctacctacctttcctctttctgtctcctgtctttctgttttcaattgtgatatgtagaatcaattctgcatcttctaaataaatcagctgtggagcaggcttccagtttcatggaatttacatgtttgaggaacagatttgagaaagcagtctaacaattttttatgcattacactataaaccaggaaatgtatccagaatgaactagttactcacataaattaattcttaggtaaagctcacatgctatggaatggtttacctgactgaatgatgtctattcctaaggaagtaattttcctgattgtagctgtgatcacgtctcagggttttcacacagcatctcaggtggttctgtctcctgaccaatttcactgcctttgtgtgattatcagtgaagttacacagcagtacaggtaagatatgctgtaaggactgctgttcatgtcaaaatgtaatcgtgaggtgaaaattgtgttcagaacaatgctgtcccaggcctattaaggacaaaggagaatgaaagagcaatgtgctgtcataaaaccttgtataatgatttcaagccatgctgggccctgacagctgagggaggaacaggaattgagttgggaccatgcttcctaaacttatgcagctaatttagtagtagggatgttgtctctcccatgatgggttcgcagtgtaaagctccatgcctgagggagttggtacaatgtgggcatgggttgatttctagcagtacaataaagagagagaagtgaggtgagaagaggaagcttatgggcatgttaggccctgcctgggaggttttggaaataaaaaaataaaaacttcattctgagaaggaaaagagtaatacaagccttggtgcaggctttgcctccaagcctgaagggaacaggtgtgaaaaacctatatccagtccactagaatagccctgcaatgaagacacaaagcctgtagctggagtgtgtctgtggatgccacatctgactctgctaaacacagcagacccaagggtgggaggccactgaccatcctatctcagtgtctgacctggcagttttgagcctctgggtggctactgggacaggctggagaaggtagtgacctcaggtgcagtatttgggactaggtttctgaaagctacttgtgtattctagaaacatgcctgtttctcctctgtgcagaaaatagcccctaaggaaggggaacatatacatagagaagtagtgactgtttgaattaatcaatttatttattatttgtctgtttctctgctgactgcagacagaaaaaataaaatacagtggaagatcagataagggcaactcacactgtgacaaaggattttactatggaaaacattgtcaaatcatggtaccttgcctatccaatagcatttctctaataaaatattttctcaagaaggttattttgcaccaattaaacataaggctttgtcattaaatgttccaaagtttaaattgagttcctgtgggttgtatgtgcatttagtagtctgactgctttcccacaagaaatcaatatttctctaagatttgtgggaatatactattcattccaatagagacgattaaaatgttaacatgtaacaaactgcaaatctggcatggaatgcattgttttcatacatgcgtttagaacagaaactcagattggccattgtttatggggagttagagtatatcagacatgacaaatgtgttattctccccagataaatgtattttagcctgttgacaccaaaatgctcagggacctcaagttaagactgaaggtgaaaaagaaatacaatggtggaagttaaaacatcaccatcctaaaaacaactgtagtaaaattaaaattctgaaaataggcaacagcaatgaaaacaccaaaaatccagagacaatcaatatccaaaataataactacaaaccattgaaagcaaatcctcaaaagtatgtttgaggttcatggaaaagactactttttagactccacaaaggttggtggacttgaagttgtgcacagatctgcatttagtgttgtttgccacttcttccttaaattttctgctgacttgaattcaaagcatagactttatcgttcagactggtttttgtttttctagatcaactgttgaaccaagtgggatgctggaacgataagcataaactggaactcttccaggcaaatcagtataatagtcaccctaatgatgacccattcctgggtccttctctcatgaccattccttgtcagtctccctgcctgtgaatttcactttcgtccacacttcaaatgtagagtttatcaggggttccatttttcttcatctttgggagtgacagagttttcctagtgatcttatacacttacaacttaactccctaccttgtttctcatgacattcaaagacataactttatctcttaatctatagacccacatgtttactaattactatcacagagttttccataaatagctccaggtgaacattcctaaacccaaactcattctccatatcccccaaactcccctccctcctctgtcttctgtcttggttttcaccgtctaactagttttcttctccttgccatacttctactctgcaatcaatgacaacagaaacagacttttcttattttattttaagttcaggggtacatgttcaggtttgttatgtaggtagactcatgttgtaggggtttgttatacagattgttttgttacccaggtgtgaaaagtgttgacttagagcatattttgagaaaattattatgcaaaaagtatctaggtctacattttctgatgtgagttacattacaagagaacctcttcagtaaccacagcttgctataatttcatgttagaaaaagcaccatattacaaggataagacatgggcacaagccagtcagaatgcatgcctcaacaaatcaccataaagcctggccctaaacaatcagtaagcacttatgatgtataacagctaaatatcatttttgaaattaagtaagactcatggctcagaaggggaactaggggagtggcaagactccaggacaccactgtgttcccccactaactggttcttccatttttgtcactgatttacatgtgataaaatacacataggattattgaattcctgactgcataattacgactggtattttcaaagccaacagaataaaagtgttcaacctgacctataggatccattatggtcaacctcctgtcacctttcttagctcatatgctgacactctccacaacctctgtccctaccattctgtactgtgcatttgcttttcctccaacagaagaaaatgggccccatttttccggggcctttctactcctgttttctcgcagacaaggttacttctccctgcacttccctccctgtgctgcttaccaactacccctgaccaagtatcccctttgtgatctagtggattctaactcatccttcaagtctcagctcaaatataccattttcagtgaaatatttatttataccaaactcctccatacctctagaagattaatcatttgcttcccttggtctctgtacatccctctctgctagccctcaacataccacattccaatgatatctatttcacacactatccccagagactgagcttccagaggcagatactaatcttatcattgtttccatcgtgcatctagttaggtctcaatgggtatttgttagataaatttcaaattcccacaagtgtgatgctgacaggtcataagcgcaggccccttccatggaagaagggctctgctggtgaaacatggaccatccctgtgcagacattcagcagaaagtctatgcacactctttcttattttgatggtttcagtccaggtcttgccaggcaacagatgatattcccagatggtacttttggagagactttcccatagggattatttacccaagtatggatagagttaaaagaaccatcaagaaatgctactccattagaacggaaggaacaaggggcagaatggttatacccaaggtccagttgagaataggagtcatgaaagagagatataagatgaagtaggctaaggatattgagttctcttcccttttatctccgtatccttgatcctttcttttttctttctgctacttccctttcaccatttgccaccagaagctgccagagggcaaggaaatccaggcaatgcatcccattgagatcggctccttgggtacagagcagggtggaaaagaacagaaaataaataaagggtaaagacaggacagggacctaaacaggattgttcaatcttgaatgcctggcacttccaagaggcccaggacacatagaaaagaaatatttattacatgagtgaatggatataagtaggagcaagtctcctgaccctcacttattccaaagactttttcatttcaacatttctgcatgttagcctgttgcaaaaccacaaatctgctgccaaaaggtaaggctggatgtttggttctcttatgaacaggagaagactggcctataactgtggacacaagggaaagcattttctgacattcagatcatttggaagcatataaaagttaaatctgttctacattgtgttggaaagaaagaaaaaataaacaaacaaacaagcacaacaacaacaaatcacagagaggaaggaaaaaaaagaaaactgatgtgctgtgtccccaatttgtgcacgattctctgcagtggttcaagtttatcccagcttatcacttaaaatcaatgacctattttcttacccttgcctacgtattctctgtatgatgcactttgaaaagtgttgctcctcacacaaacaatatcaaaagccacctgggtgagttgtcactccttgttactcatccccgctgggcaccttcgggaaatgagggtgaatttgaggaggattcagagctggtgaacaagtcccacagagatgtggtggggaagagtggcaccagatagcacagaagctggccattttatttctcatcaaaagagcaggaaataatatagtcaataagaagcaggaaggagccaggggattttgtgaataaacaccagagtcactggaagaaaggacagaacaaatccttcacgtagccttggatgtccttgttctgccctgtagtgaacaagggaaaggggaagagtgtgatgaatagatcatgtcaggaaactatcagacacctcagcttctctcgtgtctactttatctcccagtttagagaaaaaaaaaaaagatttccttcaacttttcattgtaagctattgtttgggcttataacaggcatattcaaattgcagatggaaatgatttcagaaactgtattgttctttttgttatttattgtttcatttttaagaccagaaaaagcacacctcttagagagtgtgcctatattctccaatgaatatcgaagataattttctggtatattttctgataaataaaacaatataataaggtagttgctgatatgtgcatgcaaagctgaagtttattgttcttacttttctacattttgagcttattataaaatctatgaaactttcaaatatgtgtaaatatataaaatatacatatatagactatatatataatgaatatacatatacacattccatacacgtataatttatttttatttatcttttatttttttttattttttgagatggagtttcactctgttgcccaggctggagtgcagtggtgtgatcttggctcattgcaacctctgcctcctgggttcaagtgattctcctacctcagcctcccaagtagctgagattataggcatatgccaccacgcttggctaatttttgtatttttagtagagatggggtctcaccatgttggccaaactggtcttgaactcctggccttggcctcccaaagtgctggaattacaggtatgggccaccgcgccctgccatacatgtatattttaaaggttaataacaaaaccccaacctgcccaaggcctacttaaagtacgctctcagtaagtttcagcacttttatgtcactccttcattgcatgctattctgatctccgccagagtgaattttcggtagatttttttccttgcttctctttttagctttatcatatatgtaagtataagaaacatttaattttatagttttgtgtttttttgactcctatataaatgaaactgtagtatattcctttgtaaacttgtccttttagttcaatatcatttttttaaaattcattcacaaagataccaataattgtatttcttcattatcactattttataatattccactgcatgggtatgccacatattttttcctttttattttaatttctgggatacatgtgcaggacgtgcaggtttgttacataggtaaatgtgtgccatggtggtttgctgcacctatcaaccggtcacctagatgttaagcccagcatgcattagctatctatcctgatgctctccctcctcccacaaccctcgacatgccccagtgtgtgttgttcccctccctatgtccatatgttctcattgttcagctctcacttgtaagtgagaacatgcagtatttgattttctgtttctgcattagtttgctgaggataatggcttccagctccaaccacatccctgcaaaggacatgacttcattcctttttatggctgcatagtatttcaaggtgtacatgtaccacattttctttatccaatctatcattgatgggcatttaggttgactccatgtctttgctattgtgaataatgctgcactgaatatatgcgtgcatgtatctgtataacagaataatttatattcctatgggtttatacaataataggattcctgggtcaaatgttatttctgctctttaaggagtctccacactgtctttccaatggttgaactgacttacattcccatcaagagcgtaaaaagcattttattttcctggccaacatggcgaaaccctgtttctataaaaacacaaaaattagctgggtgtggtggcacacacctgtagtcccagctaattgggagactgaagcaggagaatcacttgaacccagaaggtggaggttgcagtgggccgaaattgagccactgcactccagcctgggcaatagaatgagactctgtctcaaaacaaaaaagtaaaataaaataaaaatagttttcctatttctccacagccttgccagcatctgtggtttcttgactttttaataatcatcattctgactggcatgagatgagatggcatctcattgtggttttgatttgaatttccctaatcatcaataatgttgacctttttttcatatgtttgttggccgcatgtctgtcttcttttgagaagtgtctgttcatgtcctttgcccactttttaaatgaggttgtttgttttttcctgtaatttgtttaagttccttgtagattctggatattagacctttgttaaatggacagatggcaaaattatttttcccattctgtaggttgtctcttcactctgataataatttcttttgctgtgcagaatctctttagtttaacaggctccatttgtaaatttttgcccttgttgcaattgcttttgacatttctgtcatgaagtctttgcccatctatgtcttgaatggtattgcctagattttcttctagggtttttgtagttttgagttttaaatgtaagcctttaatccatcttcagttaatttttgtatgaggtgtgaggaagatgtccagtttcaattttctgcatgtggctagccagttctcctagcaccaattataaatagggactattttccctattgcttgttttcatcaggtttgtcaaagatcaaatcgttgtagatgtgcggtcttgtgtctgagatttatattctgttccattggtctatctgtctgtttctgtaccagtactatgctggttttttttgtttgttgtttgtttgtttttgtttttgtttttacagtagccttgtatagcttgaagttgggtagtttgatacctccagttttattctttttgctgaggcataccttggctataagggctctttttcgtttccatatgaattttaaagtagttttttctaattatgtgaagaacttcaatggtagtttaatgggaatagcattatatctataaattactttgggtagtatggccattttcacaaggatatggcacaaattgttgatatattctagtggatacttgtgttgtttccagttttgttattgtttttctttttgccgtgttaaatgagaccactagaatataaccactggatcacagaatgttcatctatgtcttcctaaggtaatgccaagttgttttccaaagataataatacaagcttccactctagctgccagggtgtgagggcctctgctgctccacatatgctaatatgaggcagcacatgggattgtcagactccctgatttttgctagtctgttggagatttagtggtatctcaatgtgattttatttatatttacttgaaaactatatgatgtaagtttccagttgtgtctaatttcaaaagaaaaaaacaaacaatgtaacagaacaaaacaaaagcaaacaatataacaaccaaatggcaacaacaacacgcacaaaataaacacccaaggaaccttatttaaattatcattcttgagccaatgagtaatttactgtttttgttttaatgtatgctctatcttcatctgttaggagattacctcactatacagacagattctccatacagatcaacctaacagtaagaaatgtgtgtgtttggcacagtgccttgggaagaagagctgctatgtgtcattgatgactctattgtttcaccagttttcctttagttactatacaaatgggaacaaggatgggaattagggaaattttccaagtgtaagaagctttcagatcttctcacatcacttattggatatgcagtgacacattagacctttattttgtataaaagttgtctgttccttctcttgcttctccttcttccaaattgttgacctgcatacaacatcaataacaaacccattaaacaatttttaagccaatttagtagccaccacttccaggtcactaccaccataccattttgaaagtggctccacacagggcttcttctggaagtttatagtatccccattcagggccaactgtgcaccttctgcagaatgagatggggttccccaacttttgtgtatgttttttaatcctctcttattctgggatgttaggccctgaaaggacacaggaacagggctgatcatgcgtgctttcagggcccaaacatccaagacagtttgtaccaggataaccccaatagttgttaaaatattgaagcattcccatgcaggttggtcaataagcaattgtctcagaacttgtatggccaatcacaatgggaagcctctaagactcttttgtagcagcatagattggtgtctattttgaatggttggaacattgtgtgtgtgtgtgtgtgtatgtgtgtgtatgtgcatgcacctgagttagtggaagtaaagtaaggggaagagaggaggcaatgaggtttgtctatgacattctcactctcccaggttgcttcttttctttacaaaatccagagcagaccactttcaattttgctttacttccctttccatctatctaggacttactgcagcagacctccaggttttgtatctttactttctcccaagatcagcctcatgaccagactttgatggttggtggagtaataaggggagtccaatcaaccaatatactaagtataaggaactgaactgggagccatttcaaaaatgtatctatcatccacacacacacaaataatgcataatgaccttttgggtagattttaatgaaggaaaatgtaaatcctcaatgcaggttgcaaaaaatgaggatgtcaaagtaacccataataatgcctcttgtattattcatggtctttgatgaaagattttttaataaacaatttcacctttatcaaccaaatttaattacatttgtaccaggataattctttacttgtttggcttagaaatgacaaagcttctttccagattcattatgtatttttaggatttttcaagaaatcaggaagtaagagttattttcaaatgcttttacaagggtgaccaagaggccagtgttactggaaaggaaaaatatatgatgtcaaactcaacccactgaatgccaaaaataagaaggtattcattactgaacccagttttattggcagggaaaaatgcaattgaaaataccaatcaccagtaaagcatatatgaaacaatgctctttcgtagtcattttgcatttaacaagtttttaatttttttaaaaaaatgggaatacataagatgcttcctatgcaaataaatttcatgaatttcagtgaaaatactttgttttcatcccaggttcaccacactctttctatctgacagatttttttttcaacagaatatgggagtgattttgtccagttattcttctaggtctccgtggaaatttctttcttttatagataccatctggcctaatgagattctaacagttctatacacactctgtctttctttgtatttgcattttttcactggagtcattgctggtagtgaaatggaaaaataaggggaaaaaagtatgtatgttaaataagcatggcagttttctctgtcatttaagaaaagtaattacaattattcgtttgatttactgaatgtaagtattcagtttgaacactgtccaaaggatgttgccttacttaaatatccagtgatcctaaactaaaattgcggctgtagtcactgatgggtttagtctaggaatatataatcttgtgtgtcttcaaaatgttaggaagaaatcttcttaagcaggatttcattatgtgttttcaatcactaatcttcactccttgtctctctctctctctcaccccgcccccccgtgtgtgtttgtgtgtgtgtgtgtgtgtgtgtgcatgtgtgtgtgtgtgtgtgtgtgtgtctgtatgtttctgtctgtagaattaggtggagggttggtaagaataaatacaatcctacactgagatgtagaggtagcaagccaaatttgaggtaattatgctaggactcacattgttagcttccttgttcaccaaatgtacaaatttagctcataatcaatatttttaatgcaaaagtttatataaggtccatactgggtaaggaaaagaaaaaataacattaaacagggacttacatcctgacaacttttgtctcatgcatcagggactctgtcctatgggatagatctacgcgtatttggggaaacacattggccagtggtccaaagtggagggtagctctgggataagaaaggctttagattcatttttcaactcttacatttactgttgacataggacatgtttcttaaactttactagcctgtaaaatcagtggagtagacaagaggagataaagtacctaaaagtgtacctagcacataggaaacaataaaaattatccaattgtgttttaagaacctattttgactatacagctatgtactttgaagtcaaagttgtttacatgtgagaaaggaaatggaccaacagaataattatagatggcaacatcctttgcctaatgaatcatttgttaaaatacattcatctaccatgtgtcagaggctggtgctgaggctatgtaagttaccaaaggaggcgaaatccatgctaccgtggagctttcaatctaacaattaatgataagcagatcacaacatggcagaatagtagatacattagaaaaaagtgtctgctcccccctacacacatattagtcatttgtaaatgtttagaatgataaacattaaaagttacattttctttaaaaatattttatttggccttacacatggaagtaattttctctggctaggcttgtatttttattatgatatgtgaagcagttaacataactcatattaacactggctggaggttttatcttcaagggcagctggtgacagggccattaaggtccacagagagaggtggaaggaagggtggtctgaatgggcaatttctcatttgttggattgatccttgattttatcagcatgctcacgttcaaaaaatcccattgtgaggtataatagatgacacctgatactaaaaatctacctaccagcctgaacagttcagaaattaatgcctctcataacaccaagagatttgataatgaagccagctcagtagaggtcaaggggaaatgatattatgtgtgttcccctatgaatcaatgtaatcctattgcatttccccagatgttcacccctggcctgtgcagctacaatgtgatctcaaagactttcataggaatcctactaaacaattttgtctaaacttgaggcactgaaaaactgtgtatggtgtaacaggtggagtttacatggcaggttcctttgtccctggagatctgatcaaatggatcctcatcccatgctccttgattgtccggagtacttccaagtgttcagagagttcttaggagaatctatagtctcatggtcacttttggttctactttatcctctaaatttgagttaccttgccattctgtgaaaggtttctctgttcttcattgccttgacccagatgtgaaatttcatcacctgctcaatttccacacctcccaaccaaccttaaaagtcatttgaatatagcagattgttctgaaaatttagcaatgtaggcgttatggggtggaggtaagggcagagccttatgtgatgacaacacaaacaccatcacatttatttaaaccatgactttctttaaattccctttccctttccttcataggaacactccaccagcagcttcttcagtttatgtcctcagtacccagcctggtcccatctctcttctgggctctgttttgtgtattcaagcatatcagtatgctttgaagaacaaaaggaccttgcttaacacaatcctcctgctcagaagaaatatgtggttttaaataattttgttattattttaacatggcaaaaattcttgggcatgctggagtgtcaggtccatgggggagaaagatgagttgaagctggacaggtaagacgcaaccaaactggggaagaattagtggcttggtgaagtctttgaagtttatacagttgaaaacatgtagtcaatgaagaagtttaagggcagtgaaaccatgattaaagctttgtttttgaaagtgactataaatgagacttgtagggaggcaacagaaattttggaagaaaaatgtttagggctttgcctgaactaaaatagtagtagtttaaatgaatatgatgggatgtgtgctatggtagatcatttttcctgtgctatgggggtaagtgttagcttctttctcctggactagtgtgttagattcttgagaagatggattgtctaattcacttacaaatttcccagaagctgtcctagggcttccatctagtatgagccctgtaaatgttatttcagtgtatggaataagatgattttctgtccacatccattaagggcagctttagtcaaaattaatacatggatatggttgttaaaaaggatttttccacattgaaatttaaatggatccaaatcttctagtctcctggggcttcactttttacccagtaagatgatgggagtcactatccctggaaatagaaggttctagctgctctactcacacacatacacacaaaaccctcagtaatcatttttacctggtattttcgtaggagggtaaaaagatgacatttttaaagctcttttctctcatctcaaccagcttctctcatctcagcttgtctgtctgtataacttgcccctggactgtggttctgagctcagcctcaggcctattggattggccagtctccaaaatcaaattctgtagcacattgtcccatagttttactgggtaaaggaagatgaagacaatgcaggaagagaacaactgactgtcgaacattattcttctcaaaatatattggtcattcccactctaggggaaaatttaaagtactttgggttacaatgaaatatcagtagcctctttttcccctaattaattctttccctgtcctttctggattctgaaaatccactggtgttcgggtataaactccgaaattgtttgtcttgcttatgagggcattctaattctctgtctaaacccctcttatctattttctacaggattgccagttaaaatacaagactccctgttaaaatttaatttcagataaaaaataatttttaagcataaggctgcagcatgggatatactcaatacaggtacacctcaaaagtattgcaagttcagttccagaccaccataataaatcaaatactgcaattaaagaaagtcacactcttttgatttatcagcacatataaaagttatatttatactatactgtcgtttattaaatgtgcaataacgttatgtgtacaaaaaataccttaattaaaacattttatttactaaaaatactaacaatcatctgagctttcagggagtcctaatctctttgctggtggaaggtcttgcctcgatgttgatggctggtgattcatcagggtggtggttgctgaaagttggggtgattacggacttttttttattttgagacagtctcgcactgtcgcccaggctgcagtgcagtggtgtgatctcggctcactgcaagccctgtctcccgggttcacgccattctcctgcctcagtctcccgagtagctgggaccacacgcgcccgccaccacgccctgctatttttttgtatttttagtagagaaggggtttcaccgtgttagccaggatggtctcaatctcctgacctcgtgatccgcccgccttggcctcccaaagtgctgggattacaggcatggccaccgtgcccggccagactgtggaaaatttttaagacaacaatgaaggtcgctacattgactgactcctcctttcgtgaaagatttctctgtagcatgtgacgccctttcgtaccatttttacccacaatagaacttctttaaaaattggggtcaatcctctcaaacccagcagctgctttatcaactaagtttatggaatatcctaaattctttgttgtcacttcaacaatggtcacagagtcttcaccagatgaagaaaccactttctttgttcatccataaaatgcaactcctcatctgttcaagttttatcaatgggattgcagacattcagtctcatcttcaggctctacccctaactctagttttgttgcagtttccaccatatctgcagttacttttccgctgaagtcttttttttttttttttttttttgagacagagtctctctctttagcccaggctggagtgcggtggtgcaatctctgctcactgcaacctccacccaccgggttcaagtgattctcctgcctcagcctcccaagtagctgggattacaggtgcccgccaccacacccagctgatttttgtatttttagtagagaaggggatttcaccatgttggccaggctggtcttgggctcctgacctcaggtgatccgcctgccccagcctctgaaagtgctgggattacaggcatgagccactgcgcctggcctccactgaagtcttgaggccctgactatcattgataagcgttagaatcaacttgcaccacaatatgtattgttttccaccttctaagtacgtggtttgtggtaccccaaaacaaccacaataataacatcaaaaatcgctgatcacagatcaccataacaggtataattttaattttaaaagttcgaaatatttcgagaaacaccaaaaggtgacatggaaaaaggaagtgtgcatatgttgtttgcaaaatggccacagtacacgtgctcaatacttggttgccacaaaccgtcaatttgtaaaaaatgcaatatctgcaaagtgaagtgcaatgaaaagaggtatgcctgtttactaaaaaaaaaaaaaagtcattgtttatctgaaattcaatttaacatggtttcctttatttctaatagctttattgagatataattcctgtcgtacaatttagcaatttgaaatgtacaatttaatagtttttagtaaaaacaaattcatatctccatggctacagtagacatttttgctactcagaaagacccctgtaggcctttgctattacctctcaatgccccatcccctgtcatccccagacataataaaacacaaatgtactttctctataaatgtgcatattttggacatgtcatataaatagaatcatgaactgtgtacacctttgtgacttgcttctttctcttagcatgaagtttcaaggttaatttctgttatagcatgtatcagtactttattatggagcaatattgcattgtatggatctactatatattatttatcatttcatcacttgatggacatttgagttatttcacattttggctattatgaataatgctgctatgagcatttgtatacaagagtttgtgcaaacatatgcttttatttctcttgggtatatatctaggagtagaattactgtactatatggtaactttaggtttagtagtttgaggaactgccaagttgttttccaaagtggctgcaccatttactttcccaccagcagtacttgagggttccaatttctctacatcttttctaataattgtcattgtttcttttttgattatggttttgatttgtatttctctgataggtaatgatggtaagcatattttaatgtccttaccggccaattttatatcttctttgggtgaatatcgattcatatccctcactctttttttaattgggttatttgccttttttcattattgaactgcaatggttatttatatatactatgtacaagttacctctcagacctatgacttgcaaaagtttctcccattctgtgggtagcattctgcacttttatttgccaaattgtatttgcttaattctataccaaaggacactcaccttacataactcaaaagtctccataaggtattttccaaacaaagaaggacttctctcactgaaaggaattttgctttcctcctggactttttggctccaagtgtggttgacttttaaaataagtttatttattttcctgattgaatttctctgtgttctcattagtcatccgattttcagcccttttctgttgaacccttttcatcaaaaacaggtactgagaaagaagatcttgttttcccttaaagttttcccttaaagttgttactgagttaaaatgtagagcctgaattgtgaagtggatgataagtggtcttcacaattaccctggaacatctccttgtacatatctaacaaacacactcttttctcgtaagaaccaaaacaagaggcacctttgtgattatctattcaagacaccttataaaatatatctcatttgtatcatctccaatagtaacccacgagccatctaatagcaatttcagaatgaataaaacaaaaaatagcaatatggttgtgacctgctttaaagatagtagtgtacttatattacaggaaaacaattgaatgggactacttaaagggtaatttatgtaaaaatatataccattatatgagatacatagtaggtgctgaataacgttagtttcataattgttttccttattcagtatttaaatttaaacccctaaaaataattcactggggtatcaaattatatgcctacatttgtaaactggaatcattcagtaactgcaaaatattaagtatctataaaaaggcctaggcattgtattagagacttaactcataatttttcatttatttaccataattctctgttagatatatataatcacttttaggttacatatatattcactgagttccagtaacatattcaaattcatataagtggtaatataaaatctgctcttcaaatatagagcagtctttcctgaaaactcatgttctttttaatatagaacatttcatttcaaatcctatatattttacaaatgtttctttttccagagatcttctctgatcactctgagtggaagtaatttgttctataatggacctccagagtaatttcactgggaccctcctatggtacttagcattttctacatttttatatttattggtttctcagtgttttcgctgtaattttatttcttctcccatcatctctccttctatattcacagtgatagatctttcactacaatgtgtttactaatatgttagaaagagccaataagtgatatgcagcagtgatccccaacctattcttatcatgacaaacatagacaattaaggcactgaaattctacttagattaaaggtggattagcttatctcgatcaataacaaaaaggatgggcttgaaaatttctaaaaagcataacaaatctaaaaagtttgtaaggaattatcattacaaaactgatgagagagagaggtacctaaaaaagtaagtagagcatagaagatgcttttactctggatagaagatgcttttactctggaaaaaaaaatccatctagccaaattttaactttgtttttctaactgcctaaaatgtgtgagaggtcaaactccagaacacatccaaaacttgagagtttaacaggaaatcctcctaacgttgagggggtatcccaaatgaataatcctggagaagagatttttaaaaatcagctttcgtattcatttcaaacccatattgacatcaattagaagttcacaaactatgaatttatgataacttttgagcagaccagagggactcctaggaaccttaaaacaaaaagaaacagtttgtaaagttgtatctttatcttaagcccaaaattattgctgcagattttttttctagggtgaggaacatcatgcaataatgataaagcatatcaaatataatcaaacctacagaaaatgaggtaaaatgagttagaaaccagaaaaaaacagacagcaagaaatagaactagaaagaatttcatatatgggaattatcagagacagatcataaaacagccatgattactacttttatgaaataaaaggtgaattgagaacatattccaaaaacagaaacctataaaaagtggcagatcaaattaaaaacttacaaaatacaacttgtagaaatcaagaatacaataactgataaataactaaatggatgaattaaatggcagattagatgtaactaaagagacagccaggaagaaagatcagggaaattatctggaaataagattgcagagaagaaaggataaaactatgcagtaaatttagttgactgggtggacacagtctaagttagcgagctatgaaatggaagcaaagccttctgattccctgttactttctgggtgttagaataaattgctttactttatacttcaatataatttgctataatcactaaaggaatataaataggtaaattaacttcagaaattatgtcacaaaaattgcaggataaaaaatgctgcataccttaaatatacacaataaaatttattttaaaaattaatgaaaatattaataaaaatagaatagtggataaaataataagaaaaattaaaattgaaagtacaaatttgaaaggagaacacagggtggttgaaaaaatgaaatgtatttacaatgaaattaaatgcaaattgattaaatgctctagttaaaaacagattatcagattgaacatgtatattctgtttataagatatatgtgttatttagatgtacctaaagcataaagataatgaaagaataaaaatgaaaatacgtacaaatagtaatcaaaagtacaaataataatcaaaagaaaggtgtagctataaatataacaaaaattgtcttttagccacaaagcattactggtgataaagaggttcattttataatcatgaaggtttgagtcctccaatcctaaatttatattcacctggtaacagttttaagatatataaagtaaaaactgataagaaagaaacaaatattgaccaaaattaaagaaactgagaaaacaaagagtaggaatgagttagaagaattgaacaataaaataccatacataccaaacaactgaaaaacacaaattacttttaggcatatttgtatccattatggaacattcacaaaatttgatcaagtgctaggtgtggtcatgtaaatttatatcaccattttggaaatgttggataatatctattgatagtatgtttgaagttacatactcctttgaaccagcaatctcacatcaagaaaaatactcttgagaatatcatgaaattgtcttttagggcatatattcaggaatgtttcataccaagactatttataatagctacaaactggaaatacccaaaatgctaccaataggagcatggataaaaaaactgtattgtattaccaaaaaaaaaattctatacaacaaatggagaaaatacaacatctacagatgtcaacttgaatgaatcatgccatcaaatcttgagtaaatcaagaaacattccaaatgatgcttaaaatgtaattccatgtatgtaaaattaaaaaaaaaaatattagtaaatataattgtttagaactgtgtacataaatagtaaactacaattttaaaaaatgtgcattacaatggtaaagatagtggctgtttgcacacagagtgggaaggaattatagagggcttctgacatgttggctgtgttctgtttttcagcctggatgatctaaacatgtatattttccacgctgttctctttgtaagttatatttgacaaataagaagatttttaaaaagccaatttgaaactattttagggttcataggtataaaagggagaagtagctttcagccaaaagggagtctccagttttacctgactgccttaagagccttggaggagtcaatgtttatcttctctaacccttccagggaggtcattatgctatctcctactttgtagtccccagatcaaggaaatttaaaatctcactctacttgatcttaatgagctcttttgtttctttacctccctctctccgtctctcctttctgtttacaaaaatgacaggttttatggtccctgtggtagcagttttatacagtcttataacaaattgtctcaacctagatgctattgacatttggactagataatgctttggtgtgtttgtagtgagggctgggggtgggggtggggctggcttatacattgttggatgttttgcagcatctctggtctctacccctagatgtctgtggcacaccctcctttcccccagccttccttcccacttgtgacaacaataatatctcaaaatattgctaaatttcacttaggggacaaaacagcactgggctaggaacaactgacctacagctatgggcaaaaggagtctttaacaactattgttggatcagtaggtatacattcaggcttcacatataggtgcaggtttaagcttggtaagagaggacatgaggaggtatagctaaatatatagaggtacgctatattgaagggaagttacatctgctggctctaaatggtgaaaattgagtggaagttttgatcagatgaatgacaacaggaaatttttaaaaagcccaatcattaaagtgatttgcaaatacattaaggtagggatctcccatcatggttagtattctagcagaagctgcattaattcaggaatattgaagacattatccctggatatttggacaattcagagttctggtttccaaggtctcctctactgtcaggaggatgacctttaaataaaagactcctggacttatcagggacagtgtcttgtaaaaagccagtgtctttctctgctgtctcggagacagagtttgctattaaggatttttcattgcttttttgattgcttgtggccttcaaacagtgttgagtaaaaatacattttcatttttccagcatttctgagccaggcaattgctatttagtttagaaaagaagattggcttttttctattagtgagtgtaaaaaaaaagtattgccagttgcagaaaaaaatccatagaaagactctctctcatcatcatcatgtatatttgactaaatgtttcctcttttttagggggagaccacatgacctggatgacctaggatagccctggttatccttctgcctcgcatcctgtctagtttagcacttgttctaggtttttcacttgtaataaaattgtcattaataaccatgacatttaaataatctggaatgcttttggtagactgcgactttgacttttagcttccaatatagtcttacctaagagcaagatttttaacatgcgcttagaagtcgcacatctttcttttcatgattctttccaaatgcatcatagctaaatctctctttgtaaggtagcaggcagatgtttgctgacataacaaagtcttctcaaatgcgactaaggactgctaactctgtggcttcaggtgtctgtggtagaggcatcgggcttgttgcccccagcaaccacttggtgtaccagccagttctatgacctgtgctaaacctgcctggtgcaggaagatacagtacagcaactgggagaggagttagagtaatacatggggcattactggttaggaatttgtagaatatgtgagggtaataaaagttcaggcttccagttgtagaatgcctagaatagtataaatgctatcactacagtggttgtgttatttattgtatggaataaatctacaactgtttatttagtttgttgtttggcaatgcttatttttaaataaacctttttagcagcagtagctcaaataaacagaagtgcatgcttagagaatttccagtagctaagaaagtcaatgataaacatgtacttgagcaaaatgtttctctacatttagcatcctccatgggaactgtagtgaaatcactgaccacacaaaagccagaagacctaaatctgctaaagaaacaccagcatctacttaaaaaaatcacttgttattttaggaaactgtgcctaaggatgacaaattaatacagctctgaagtgtgactatcaaataatagttcttttaaattaacttcactcattttctattgcaagtattgttatccatatacaaaaaaaaagtcaaactgaagtagttgcaaatgtcttggatttattaacagatatctttgcaaacagttaaatgatgccagttttatatcgatgttatcagatggtttaaagagaaagccagttaaggccaatatgggaatttcttctagttcatggaatcaaactaaaagtttagggagttcattccaacgtaggtaatgcatctcatggtaatttcaacgctacaagaaatttagttataagagttcaaaatgaatattaaagagaaactacttgtttctttttcacagtttaatacacatacaatttttgaatgattcttgtgtcatgataaaggcaatgttcttattaaattatggaagccatggagcagaaatgtagtaacaatagcctgtgtacaaacataattcataactgggtccaaaaagccttcaataatctaccaataaaaagaaaagctatagttgtcaaaatttacaaatatgtttaataaaagaactttgaagaaaaactaatgcttattattaaatatatattttagcctggtggccctcgtttctctctacaaggcttatccttaattgtttttaaaaatgttgagcttttacataaatacttggcaaatcaatgttaagtgttccggaatcatatataactttttttgggaaactcatttctaagcattctcttaccaaactcagttgggaaattttaataaaattatgcattccaaagacatgccttcttgaaggtagagttcccagaaagataagacattaaaaattatccctgcaaaaataaaggaaagactgaatgaattaaacatgaatccaaagtttggacaacattgaattttagaattccattttggcattttagaatatcttgactcactgaaaaattattaaaaaaaagtttttcctggagctttgtttttaatcgaatgagtttatattgtatattagaatgacatcaatttgagaaggcctagagttttgcagtatcctaatttagtgaaatattttaaagaatgataaaaggcaatttatttgttgaattgcatcttgttaaaattattaacaaagaaaggtactgtaaattgaagtaaaaatgtatttatgaaaatatttggactgaaacatttgcatgtttcaatatgaaaagaaaaaagagctgagaatagagtgcacttagaaaaatagattccaaattgttgcaacaattttagtgaaagtattttctcaattaaagacattatggtctatacaataatgtaaatgaagaataaatttaaagtattaaaaatatgaaatttattatacataaaatgcgagtccatacaggtttacaggtaattaaaaataatgccatcttttcaagattccttctcccattaccaatgacataatattagagacagatttaaattaaaagttgattaacatatatgactatctatgaaagatgattagttcgatgatgttattttttacatgttcaaatgacaaaacattttttgttattttgcctttattgctattatataatgagaggagatatatattgtttatatattttagaaataattttacttttaacattgtttttgaatagaaatattttataatctaccaacataagccaatttattaattaataaacagttatttttaaaaatgtgatacattatttttgacaccccatttcattctccaaaatatcccagtttacacattaaatcacgtgttcactcatctgtgataataatgacagagtgttctgtgaatacacacatacacacagaggggcacatgtactctcaacaaataataggattttttaaaataacgtattttcaccttcacctaatcttagtcaacagattctaagtgcttcttttctttaaatttttattttgtaatgttaagaacatttaacatgatacctaccctcttagtatatttctaaatgttgactagtggtacactgttgtacagcagttctctagagcttattcttcttgcttattgattactaatttctcatttcctccttctcctagcccctggaaaccactatttcacaattcaattctataaatttgattattctttttttatgaatatataacatttgttcatatttaaggagtatatgtgatactttgatataaggatacaatgggcaaggatcaaatcactgtaattaggatatccatcgcctgaagcatttatcatttctttgtattaggaacattattctactcttttagttattttgaaatatacaataaattattgttaactaatgttgccctattatgctaccaaacactagctcttgtttcttctatctgactatatgtttgtaaccattttagacacctcatataagtgaaatcatgcagtgtttgtctttctgacttacttcacttagcataaggttcatccaagttatggcatgttgcagatttctttcttaaggttgaatagtaatccattgtactatatatatagtacaatacatatatagtactatacaatggattactatatatctattactatacaatggattactatatatatagtactctctatatatagtactatatacatctatatgtatatagtactatacatatagtactatatatgtatatgtatatagtactatatatgtatatatgtatatagtactatatatgtatatatgtatatagtactatatagagagagtactatatatatatgcatatatgtatatatctctcatttttttaatctatgaaaatttaagttatttccccctcttgactattgtgaatagtgttgcaatgcacatagaagtgctactatctcttcaagatcctgatctcagtacttttggataaaatcccagtagtagagttgccagattatggtagtcctattttttcttttttgagaaacctccaaattttttccattgatgccgcaccactttgcatttccatgaacggtatgcaagggttccaatttccaatttttctccttccttgccaacacatgttattttctggggttttgtttgctctttttttttttaataatggctaccctaacaggtataaaatgacatttcgctgtgtttttgatttgttattctctaatgattagaatgttgaacatttttacatatacctgttggctatttgtatatcttttttttttttcgagaaatgtatatcaagaccttagctcattcctgagttggcttattgtttgtttgttttctattgagatgtaggaattccttacatgtttgggggtctaacatatatggtttgcaaataattttctcccattctgtaggttgacttttcattgctgatcatttcttttgctgtactggagcttcatagtttgatgtaataccacttgtttgctttttattacctgtgcttttggtattatatctgtgaaaatactggcaaaaacaatgtcatgaagtatttcccctaagttttcttttagaagttttacagtttcagacctcaaatttatgttgataatccgttttgattttttttttgcatatggtataagataaaggtccaatttccttcttttgcatgggaattatccattttttccaacactatttgttaaaaagaatgtatttctctttcaacaaagtaggaatagaagaaaattacttcaacataatgaaggccatatatgaaaagtttacagctaccattatactcaatggtgaaaaacagaaaaagcttttcctctatgatcaggaccaaagtaaggatacgtatcatcaccatttctatacaacaaagaggagaagtcttaaaaagagcacctaggacagacaaagaaatgaaaggcatccaaacaggaagggaagatgtaaaattgtgcctgttgcagacaacatgatcttatatatggaaaaccctgaaggctccatttaaaacaataagaagaacaacaacaaaatgttagaactaataaatgaattcagcaaagttgtaagataaaaaaccatatccaaaaattagttgcatttctatagactaacaacaaactatctgaaaagaaaattaggaaaacaatcccaaatattgtaaaaccatttacaatagcacaaaaataataaaatcttaggaataaacttaactaagaaggtaaattacttgtatatttaaaactataaaaatcatgaattaaacgagacacacagaaatggaaaggtattttgttttcatggaaaacaatattgttaagacatccatactactacccaaagcaatctacaaattcaatgcaatctgcatcaaaatctcagtggtattttctaccagtaatagaaaaatccattttgttttttttttttgagacagagtatcgctgtattgcccaggctggagggcagtgatgcacaatcttggctcgctgcaacctccgcgctcccgggttgaagctattctcctgcctcagcttccgaactagctgagactacaggcacatgccactacacctggctaatttttatatttttagtagaagcagggtttcaccatattggccaggctggtctccaattcctgacctcaggtgatccacccacctcagcctcccaaagtgctgggattacaggtgtgagccactgggcccggccagaaaaaattttaaaatgcatatggaatcacacaaaataatcaaatagccaaatcaatcttgagaaaaaagaacaaagccagaggcatcacactttctgatttcaaaatattttacaaaactacagtaatcaaaagagtgtggtactgacataatgacatgtaggccaatgaaacagaacagagagcccagaaataaatccatgtatatgtagttgactgatctgggacaagaatgctaaaaatacacaatggagaaaggatagtctcttcaaatgtcttccatcattaatttattcactcaaaaatatacattgaggccaggcacagtggctcacacctgtaatcccagcactttgggaggccaagactggtggatcacctgaggtcaggagttcaagaccagcctagccaacatgctgaaaccctgtcactactaaaaatgcaccaggcatggtggtgcgcctctgtaatcccagctactctggaggcttaggtgggagaactacttgaacccaggaggtggaggctgcagtgtgctgagatcatgccactgcactccagcctggatgacagagagagagagagagagttctgagaaggtcccacacctcatggaaaacttagccatacgagatacagtccttatatcaaagcataatctagtgaggaaaattatatacacacactatatatttgcacacaaatatatatgtaatttaatcacagtgggctaactgtcatgtcggaaatctgtgctggatgtagatattacacaggtaatagaattagcccagaacactttatttacggagcatctcatggaactggagtgctaccaaacacatttttggaaatcccactctctatagaagaaaatatttaaagggtttttggtaagtgaacataaatcagaattttctattttgagatatataggagttggattggaaggttgtagaatctctgagttgtccaaataaatttagatgactgccgctagagaaaaactgcctttgtcgggaaagaaatgataaagggctggaattgttttacatttagtcacactaatagggatgcagagagcctgagaacctgcatatgagagatcacagattttgaaaagagccagagcttgggatgattgcccatataaaaatgcttaaatgtcttaaacataatttgagtggaattatttatatttcaagattaacatactgcttgatacaagttgcctgcacattttcctttaagtaatgggctaatgggctctgcgtctctttgcctaaattaaatgtagtttgcaacaattcaaaatgcaaatattttttaaagtagtctttttttttttttttttgactggcattcacaaaagctacagcactcttgtattagcaggtaaaatctggaccttatttcatcctggacaatccttaagctgagatattcgccaaatggcattatatctgctttgtaaatgttgatctcaggctccacttattttagccgctgggtgtggtttgtcccagagtctcctgtgagcttattttgctaagcaatcagttacactctaataattgatcagcctttctgtgttctttacaaagcagacctatcactcagcaagattttttaacactattttcatgaagtctggatctactgaggatttgatggattcaagaagacaaactaaatgactttttggctacctcaggatagacaggggacaagaagaaagcaaaaagcaaaaaaggaaaacaagaatcaaatcattttccattagacatgaatggctcaaactagtgctctctcccttataagaattaaatttgttttactcgcatagagttaggggtcagaatttctctattttacaaacagcatattttcccttttgcttttgcactttaagaacttatatgtgggggatggggaattgaggtgtctgatttgttagttgaaggttatggtaattttttttgtttgctcgtactcattttacaagtggttaaaactttggtgatcgacatgaagacccattttcttctcttgcttggactcagagataacagatttgtgcttaattcccagccaagaaattggatggaatgaattaccatgttgtagtaaagactttgtaatctggagaccttgtgattattaattcagaggggattcatcagggtctacctctgttggctgattaatcagaggatgacatcaaggtaactgggatattgtttgggcctcaagggttcttatagtgcaaattattaaataatttttattattaaatatttttattattaaattgattttattattaaattattagatgcactaaatgaagaatgaggatttattaacttattattaaagatattctgaccaaaaaagataagttgacatgaataagcaagcactctaaacttggagaaagtaggtttaggaaaaacttgaggacccaagactgattgacagcatgacactgaaaatcttctgagtttctggttactcactgtaaaatgcatgtaatgttcacctcatgggtttttgtgaaaatttagtgatatgcagaatctagacgtggtctgtaagctacacttgcaattaaatataaaatattattatttttatttaagttataattgccttttgaagaatttccttaggtcaattcatttacaaatggtaacatttaaattatgatatgccttgcctacattttcatggaatgaacagggtattaaaaaatgttctacatatcaaaccctccaaaacaaattagcaagtatgatcaagtattatgtagatggttaggggcttgcaggacaatggtgactttcgcacctttgtttttattgagttgtaaattgggaccccttttgtttattacatgatcatccatcttagtaactggccttgccttgcacctttaatagagtttgataagagtcagttagatttataagcaatgactttacacctaagggtgggatatgaaactcctggactattagtgagcaaaagatattttaaattacataaaagtgttatacagccttcaagtaagaaaataaacatttctaggttattcaaacattttttaacataatttttgagggggtataattttagatttacaaaactttataccttcaatttttgtttttaaaataatggtattaatatatcctatggctttggacaaatagatttaccacttgacctcagtttctggttccataaatcaaggggtttagactgagtgagtatgaaaatctcttctaattagaacttcgttgaccccattattaatagttatttaatgaactgatgttggaaaatgagaagcagcagtgttgctgcctcagatttgggcagggttctcttgatgttggcagtgttgttaatatggcaacacattccctgttcattcatataggtcaccaggaatttatgaggaaagaatgcaaattttttgaggaccaagtgagttccagagaccttcaaacaatgagactaataatagtgaacagtcattgagaggtctctgtgccccagatgtgtaccttacctcatttgatagtcacaacattctagcaaaagctcagtttatcaccctacattttcaattgaaattaaaccgggttaagtgattttcccaggcagaaagtgactgagccagaatttgaatctgtagtgtcctggattcagaatgtgaactattcacctttacaacattctgcctatttctagctgcagtttctatcctaaataaatcatttctgattgtattatatcttgattacacatttcaactagaaatttagttaaacacaaaacaaaacaaaacagcaactcagtaattaagaccagagttctgtctgcttttccttttaaaatatcttaccatgatataatcagactctaatgctacatggttattaaggaaatttttctgttatcagtttttttgtgtgtgtaggagtacttgattgttccatttattgcaatctatgttccatacctaagatggcaaaaccctaactctacaacagtagccaagcagacactctgaaaagtacgaaatgaatttgagattctacaaagaatctccacattttttttcaccagaaaaaaaaaattgttttctcacaaggttctgctaacagaaatatctgagataacagaatcagtaaactattaccttcgaggccaaaatacattctaaataagttatgttactgttgtccaaaccatgtattaataggtagaggaactatactctaggtaagtgggaagaaggatcaccaaacattgaagtttggagggcagcaggcagatggggaagaggttgtctctacagcctcagaagtgcaatttatcttcatgacatcagttagatcttcattgctcaggtcccaaaccttgacctaataccctgagagggcttcatcccgcaagattggatttactctatttacaagagaaactggtgtataattcacagcaacttaatacatttgcaattgaaactatagtgatacagccaactggacagctcattgtctccatttagagcaatagttcatacctgtaacactgcctgaaaagagcttccacagacaggaaacactcccggtaatgaagaatgtctgcatggactgcatgataagggttttgtgcaattgttaaagcatgagctctaactttacctcttctgtcttaaggattctttaacatagcaccgtggctttacccctgctacagagaattctataggaaaatcccattgtaatcaaaggattgctttgtgattattgagatgctaacagatgattttgtcatttatttgtattttatgtaatcagctaatgatatttacatacatctttctctatgtctactgtgccagggacatgaatgctaagtcaggacaaccatacctctgaggacagtccttggatgatatctgcaaaaattgcctctgtaattattatgatttttttcaatctaagatccattgttaaccagctcccatcttgactgccgtttttttttgtttttgtttttgtttttgtttttaatggagtctcgctttgtcccccaggctggagtgcagtggcgggatctcgtctcattgcaacctccacctcctgggttcaagcaattgtctgcctcagcctcccgagtagctgggattacaggtgcttgccaccacggccagctaatttttttgtattttagtagagacagggtttcaccatcttgaccaggctggtcttgagctcctgccctcgtgatccacccaccttggcctcgcaaagtgctgggattacaggcgtgagccaccgcacccagccgtttactgccgtttttttatattaatataatcaactacttttgactaagtcaggtaactggtctccctttgtagagaaactttgaaaacatcttttctcatttattttgctcttactccaattttgctctaagaagacaaacacattttccttattttgaacttggcagtaggagaagtggactgctgttgctgctttgtttttttcagcttgctattttccatagccgtgctgtaattaataatcttttgtagtcaatagtttctaactattcagttatcccagttatccatgggattcttaaaaaaaaaaaaattgtcccaatatgctttagaactgaactgcacttcctgcctgcctgtctgccttccagtgttgtgcttttccatctctctctcccttcttctgttttctcttctttctctttttttcccttcctaagttcttcccttccttctttctttgagaataattcaggccaaaagatgttttggggggtcagacaaattaggtagtgagtgtgtatgtgtgcatgtgtgagtgtgtgtaaagatgtgagtggggatgtgtttgtgtgtgtgtgtgaaagggtgtgagtgtgagtttgtgaatgttggatggcaggcagacagtatgcagcctggagtgttggagcccaggtggagtaaggggacatccacccagggaagggcggagagggaagtagtcagttgccagcaagatgagatggaaaagtgatggagggattaatccaatatataaagatatggagtataatggaagccagttttctcactattggagaaaagattgacagcatatggaaatagaaaacattagaataagagttataattttggcttgagattgaaggtatcagtgtaaatcacaattaaactgaaagatacattagatatgttgacgttctaacccccagtacctcaggatgtgactatctttagagataaggcctttaaagatgttttaaggttaagtgaggtcattaaggtgtgtcctaatccaatatgactgatgtccttgtaagaggaaatttgaacacgcaaagagagatggcgggtacacatgtgcagaagaaaggacttctgcaagccaaggagtgaatttccaggaaaatcaaccctgctgtcaccttgatctcagacttccagccttcagatccatgagcaaataaatttctattctttaagctactcagtcactggtattttcttaggatagccctagcaaactaatacttattggtagatataaatatgaaaataaaaatgaatgtcaatatgagtagaaataaatttagatataaatacgcatgcatatacgtatatgtatatctgtatgtaaatatatatactcatcttgtagcaggacgatccacagacaagaacccctcggacaccgagttgtggaaggaaaggcctttattcagctgggagcatcggcgggctcacgtctccaaaaactgagctccccgagtgagcaattcctgtcccttttaagggctcacaactctaagggggtccatgtgagagggtcgtgatcgattgagcaagcagggggtacgtgactgggggctgcatgcactggtaatcagaacagaacagaacaggacagggattttcacagtgcttttccatacaatgtctggaatctatagataacataaccagttaggtcaggggtccatctttaactaccagacccagggagtggctccgggctgtctgcctgtggatttcatttatgccttttagtttttacttcttctttctttggaggcagaaattgggcataagacaatatgaggggtggtctccgcccttaatctatattgcctcgctctgtccactaaagagggtctgggaactgcagtccaccgataccagtaagaaaaatttgtgttctaaatacctggttcttggttgctaaatgctgttccacactaaaaggaaccagactttttaaaaacattttactttaagttctgggatgcatgtgctgagcatgcaggtttgttatataggtatacatgtgccatggtggtgtgctgcacctatcaacccgtcatctagcttttaagccccgcatgcattaggtatttgtcctaatgctctccctcccctttccctctacccactgacaggccccagtgtgtggtgttcccctctctgtgtccatgtgttctcatttttcaactcccacttatgaatgagaacatgtggtgtttggtgttctgttcctgtattagtttgctgaggatgatggtttccagcttcatccatgtccctgcaaaggaaccagactttttagagaaatagctgattactagacctgggcagggaaaattcaagatgtagttggaacattttattttgtcaaaaagaaaagaaatgatcaaagaattatagggacatatagaggagagtcaatttatcaggcatcccactagaaaaccttgagattttcacccagtaagtgaaacaagataaatcttgaatataaactgatagaaattaataaatgaacaaatcaaatggtaaggaatcacatatttacatcatttcaaggtaatatcctgtaaaatatttatcaatcacaaataataaagaagtgactaactgtactgtaagaaatcttggcagatatgactttagtcaagtgctcaaagtgaacatcataagtaatggaacaaactaaatcttggaacagctgatagaataaaacaaggaaaacagagcatcactcttgtggcagtcttgccaaaggcataaaagctgaatataatcctgtgaacacattagacaaacccaaattgaggaaatactataatataatcgggcaatcttcgtaagtgtcaggaaagattgggaaatttccaggttgaaggagactagtattgacatgacaggtaaatataattgtgatgcatgatcttcatttagatcttttttttttttttgagaacgagttttgctcttgtctcccagactggagcacaatggcaagatcttggcacactgcaacctccacctcccgggttcaagcagttctcctgcctcaacctcccgagcagctgggattacagggacatgccaccatacccagctaatttttgtatttttagtagagacagggtttcaccatgttggccaggctggtcttgaactcctgacctcaggtggtccacccgactcagcctcccaaaatactgggattacaggcgggagccaccgtgcccagcctagatcattttttactataaagctgattattgggataactggcaaaacttagatgtggtctgtgggttacataatagtaatatattcatattaatgccctaattttgtcatcattttgtagaaataatgcaataaaacattcagggctgatggggcatcatgtcaacacacctcaaatgattcaggaaaaaaatataaattttgtactatttttgtaaattcaagatgaaaaaataagtattgctgttacaagtaatttatctgtccatctgtccatgtatctatccaccaatgtctttatccatctcctattaaagaaaactaaaatcagaaactttttttgaactcatattaattcttatattgaatttacaagtttatggagtctgttacctgagagttagaaaagataaaactcaggttccactgttcgtccagggactgtgatgagtattttcatctatattaccttatttacatttataatagttccaagaggtaagtttttgtatatgcattttacagagtaagaggatgaggctctgagaatttgaatggattattcaaggattcattcgttcagctcctgcacatcagggctcagaattcagtgccttctgccgcctggagttctttctgataaatcatggtaacttcatctggcttagggggataagcttcagtcaggcagtaagattctctggagcctttttgcagtgctagggatatgacaactaagcaaagacttctgagaaattgtcaagggagtccataaatttcagtggaagtagacctaggttagccatttaataatgagagtttttgccttggttttgtcagttattttttcttgtgactatttaagagactcagagacccagttgctttatccctaaaatgggcacaacttcctggcctgtaatttcattaggtggtttaaagaatacatgagatgatgagttaaaagtgatttgcacttctaaaggtgctatattgacctagcatgatgctgatttgtatttgggtatgagttgtccttataattagggtagaggttagaacaaaggaatacattctccctcatagatgagtcaatccataatctccaggaacttgtttttttgttgttgttttttgtttttgtttttgttttttcccctaaaagtttcaggctgtggtaatgcagtagagtgattgcataattgattccaatctttcattgtcctcaatccatttcccctgccctacaactatgtaacatcctcccaatcagactctgaactcaaccacatgacttgatttagccaatgggatattaacatatgtgacacaatcagaggcttgaagtcttgctgattgggtttgttctcacttgtcctcttctttaccctgaaaggaaatgctcagataagcaggtggtttcagcaggagggtgagagacatggaggagggctagtttgctctacacatccattgccttcctagatgagttgacagagagctgatctgtacacatacttagcgcacctaggagctgacaaaaccatctaatttactacccacagatagctcagttcaataaacacttattattgatagctcctaaacaatacattgtgattttagtaaggcatgcatatatactatgataaagtaaaaagcaaagtttctgtaactttaacatgaaaccaggagcttcaatattactttcgtacctaccagcttccattttcagcattaccttcagatgcccctatatctgcagcaatcgaggactgtatttcagaaataattaatttaggaaataaaacagcaactacttaagagatgctgatattgaacttccacctgaaatctatcccattgcacatatatctagggctcagtatagaaagaaagaactaagtatgactgtgacctagaatactccttggaaatggaaatagttaaatcatctaggagcttttcctctggaattatgggagctggtttcccttttctttttggatgggtgggaggaaaagtttgatttgaaatataaacctcttttagtgtaattattttataatgtcttatttgaaacaatatatacacagtcatatttcttaaattattattataattcaaataagtaaggatattgtaaatctcccttccaaatttttaaagtaatcttgctaatagcatttttttttttttttttttgagacggagtctctctctgtcgcccaggctggagtgcagtggcgcgatctcggctcactgaaagctcagcctcccgggttcacgccattctccggcctcagcctcccaagtagctggtactataggcacccgccaccacgcctggctaatttctttttgtatttttagtagagatggggtttcaccgtgttagccaagatggtctcgatctcctgacctcgtgatccgcccgcctcggcctcccaaagtgctgggattacaggcgtgagccaccgtgcccagccgccaataacactttttaaactcctgtgcatcatctgtgtaatgctatctttcttgcagcataacagacgtatttttattgatcgtaatatataatatcaactcttttttttttttttttttttttgagatggagtctggcactgtcgcccaggctggagtgcagtggcacaatctaggctcactgcaagctcctcctcccgggttcacgccattctcctgcctcagcctccagagtagctgggacgacaggcgccggccaccatgcccggctaatttcagtagagaccgggtgttagccaggatagtctcgatctcctgacctcgtgatccgaccacctcagcctcccaaagtgctgggattacaggcgtgagccactgcggctggcttataatgtcaacttttaaacttcattcctctgtaatggattttgcatggccaccttgcaggtagaatcagaaatgttgcagtcctcttttgaaagtgcataacaaaatcttgttttaagagaacaggtgctagggcttgtattctaaccaaactccagttcttagcaactgcattctaactgcagaattactcatacaatttgaactacactagatttctttgttcatctcttcttaattaataattgcaatgttagggaaatgcaaaagttgcataataaataccgagatagtttttttttaaatgatatatgtagtaaacatagtttaacttaaaaacaacatggagctggcatcgtcattaacaagctgtgtgattttgtacgtgttactttacttctccaaccattgccttctttatatgtgttaatatggaaaaatgtctatgatatatgttcagtaaaaaaagctgaaacaattgtatttatgctctaatcctgtgataatatagatgggattttaattatgcaagttcctaaagttagaaatacgtgtataaaagtgagtttttataacaaaagtattcctagggtactaaatacttataaaattagtctccacccaatcatccatcttcacttaacttttccactcatatatcatgcatgtgtaaatcatctctaactgatttctaaatgttacattccacaaaacaacataaatgcagggcaaatcaaacacacaatggaattgcatatcatgtactacatgcaatatttcatggatctctcatagtaagattgaagaattactcaaatcccacccaaaactgttgcccatcaattactgtatttgaaaaatagggggaaaaaacaaagaagaaagggaggaaggtagagaaggagggaagaagacaacatgatgatgatagagttggcaccgcaaaatattttctaaaaatataccaaaagattaagcaatctatgcaatcataaaatttgtagagaaaaattactcaaaagtgtcagcacatgagccatattttattcattcgtaaaattattatatggaacaattaaacctaagttttattaaatgtaaaacgatatactatctacatattgagttttatatttctaattttgttctttttaaaataaaataatgctacataatttaattttatccactttaaatggtctaacttcattcattttcagatacagaagatcttctaggtcttctgtatagaaatatatacacaccatctgcacacatacacacatatgtacaaatacatctatctatatatgtatgtatatatgtatatatattccagtatatacatacatatgtgtgtatatatattccatgtatagtgtgtatatatgtatgtatatatgtatatatattccagtatatacatatgtgtatatatatattccatatatagtgtgtatatgtatagacacacatatacatgcatatatgtatatacactgatgtatatatacattgatgtatatatgtatgtatatatgtacatatacatatatgtgtgtgtgtgtatatatatatatttatgcacacacatatatattccagttttcaaatggagccaaaacactggatttgctggctttttcccattcaagtctagaatagactccagttctccctcagctccaacatggatgtttttgaacagtcagggaagttatagatccatggtcagtatttcacagggcacttgggatatctagctatgtttaagtatgtacaattagtaacaagaggagataaagcagaagaaactaatggggttgcactttgagtgaacttttaataattcagattgaaagatagacttattttcaaattggcctgtgatatgaatagtgtggtacaggaaagaagatcagaggataacctagaacctggaggacaaaaaaagaagtgactcatgccacgtttttttttttttttttttaaatcatggaaggaattctaggagataataataaaaccacacccagtaagatatataactggttatgaaattcttccaaattatatattcaaggttatatatttttgtctagtaaaattgaccaagcaacaagtgcccattttgctttgtgagagaaaattgcatcaatttttggataccttaaaagacctcattaaaagagactattgaaagattattataaatttctagccacaacaagggaactttccttgactaattaaggcaataatctcgtgccagaagggcctggacaagggttatttctttccgggttgtcttctggttcaatggcataatagattacaacaattgactgatctatctcattgatacttattgtctgaataatcatggccttgttacctatagcttcaacaatagcaataataagacaaacaaaatacacaaatacattctgtctctcacacacacacacacacacacacacacacacacacacgcacacgcacaatccagccttggaaatttaagaacttgtccagtcgggcaaggcaggacctggaaaaacagaaccaaatagatgtgttcaggaggaagtccagtgaaacaggcaagtggataagaggcaaagacatagacagcgtacagttcaggcaggtaataagcatgaagaaggagacagcagtaaaacataaataaattaattaattaattaaaacaaaaagcatcctggaacccaaaagcacaggcagaaagcagaaaagaggtatctaagaagcaatggtctggaatccaggcagaaggcgtgtggtcagcaccagagagcacaatcagcggacaatcatgctttgggccatttaaaagaaatacatttaaattttacacatgcagctcttggatggcattgggtgagtgcaagacaaagccctcacactgggcaacctgtcaacaacatggaacagtggaactggaactgactttggagtccaacagtgctgagctcataccttcactccagcatttacaagttgtagatgagtacaacttgtacagttaacctcctcatctgtaaactgactaataacatctctttgctcatttgaagattagacaaagtaatatacatgtgtaaaacacaaaggatagtgctcagcatataacaagtgtttatagtttatgaattttctttagagctagggaaaaaaatgagtttaagagcaggttaaccacaagaaatttatgactgaattcaatgtgcatcataaaatacattaaattcttgttgcccatacttacagagttgaagttagagctgattctagcagacaatgggtgagacacgaaatggtttcaagtaatcctgggtctgcacagggaggtgggaaatgcagagggtagggagccagacaggagagttggttttatgcagaaaatgccagcagattgattttctaaagtaagagatttttaattcaattccctttgcacctcttcctctgcctgagattctgctatattacactctaaaatagctattatcactatctgttacaaagctgatgcagaataattgagcatgtccctggagaaattacacaaacaaattccttaattctgcagaattatgcagggcccggaggggattcctcatgctcccctaccttctcatcaatgttggataattagttttctgtctgaggcatatttataacatcagtggagttatcagtggtcaataaggtgatgcttgggtgccaataattgggaaacttgacattttccaattagatgaatttctcagtgttgattgaaagatccaataccggtcaccattttctgcattattttctgggtagctcagtgggacacactgagagagtatggattagaagagacaggggccagagaagggggttggtaaaaataaggattgtgttgctggaggcagcaaaacatattttccctcatctaaagaaatttcccaagagatgaaccagaatgcaaatgatctgtgctgaagtcctcgagtagactgtgagtttcctctagttcaatgtgtaatatgaactcctagcataatgcttgccacatagaaagctctaaaaatattccgtttatctttggtgaaaggctggagggaaaatggtatattcaacattaataaatatttaacatttaaaaaatttttccttttgtaatttaccccattgtctacctccagtgaagactaattgctagaatacttcagcctgccaatgagaaaacatgttcagcaagggaagtcgggatagtaatgtcctgtattacccttgctggagggttctgtaactatccattttgtcttacttctgcccggccatttcactccactgactggttctatcatatttccatttcccaataggactcttctttccattaaatccagtggctttgctagggaatgaaaagacttgggttatgacatagggttgtcatgggcttacattgcagctgcacctctctaacttaattgggtgactccaagattcctttgtgtttttaggatcttttctttaatgatatctaattccttgggttgtcctatgtaattcatgtgtaataaacatggaattgtgcaagaccccaagttgaaagcatcagttaggagttagaccatgtaaaacctatggaaataatgaagtgtttcctccattagctagaaattgaaggagtatatcttgaagatgtgttgcagggctaacattctaggatgctaacattctatatcagaaaatccagtacctacgcccaacttcttcactcatatgctgcagaaatacagaagaaatgtacctccatacctgggacttattagcattcgggtacttggtttcaatcctaatctgagacatactaccagatccccacaccctcccctcccccaaaaattaaagcttgcatttccaaactattgacaataccaaagtctgttctcattaacgattcattaaatatccaatgacataatatttgccttagacaacacaaagtagagtataccattatgggttgcttaaatcacaaattgagctgacttcaagcaatgactcccatgagattaaaatacagtatttgaggaagtagcatgcagagataaatggaatgcttactaaagagagagagaaagagtttacaataccacttttggtatagaaacaagaatctaagggaataaatctgctttttcaagtactatttttaacatttgttacatacactttgtatttaaaaaaaatctcctgacatttatggttaagaagtagcttgcaaaatctttctccagttctctcatagaggaggaaaaaagtctgtaaatattttcagaagacaagtatgcctgtaatactatgaaatgagattaagttaccctactagtaatatgatctttgcattggaagcaaattcctttttgtgatttttttcctgagttggttatacagcagactagatgacgatgataaaggtatcaaggtctaagtttttatttttattttaaaatactgtttttttttttaaatcagatacatgaggccacacaaaacaactacctagcttaatgaactgtttcaagtcaaatagctttgcaaccaccatagcggtcaatgagtaactttgccagccagcccagaatccctgtcccaagtgcttcgtctcaaacccacctacctctctgccctacaacctagcctgacttttatagtacttgctgccttaatacttttatatttttataattcaaatatgcatccatagacactagagtttatccaactattttttttctatttggttatgtcttttgtgtcttttttagtctacatgttcatccaccattctcttcttttttttaatttaaaaacacaattcattgttgagggactgggcccattcgaactgtagtttcccacagcctggaattcgagattgcagtctctctgaatccagccaggccttcatgactttagcaggactgtaggtggagttgcttttcttcaacaggtgcaaaatgcataaatccactaaataattgagggttgaaaatggtgatattcaaaatccatatttttttttacatattagttgaaataattctgtaggaatcacttgctctcatctcctatttagttacccaatgatattgttcatataggaaaggcaggataaaagccagatatttaccagttttcaagataatgatttttttcctatcatctttgaaaggtgatcattttttttaacatggcagtatgaacacatggatttaaacttacttatttgatgcattttaatacattgcaattgttaaccttgtggaagctaaaattgtctcttatttgaagatgatattttctatttaaaaaatgctgactaatgtgtattgactgataacttttttgagtactttatatgtattattcagcgtaatgctcccagaagtcctcaaagtatcctttcacaaattagaaagctgaaacacaaaacatttcagtaattctccaaagttctcttagctagatgagataaaactgcaatagaagtcagggctaccttcttgatcctgctgcatttattatggtacaagcttactaatcaaattttttaattttcagatttagtttttgtctcctatagcaaaaagatgtatgtgagttatcaaatctacatttatgcccattttaccaaggaaatggagacttagagaagttaagtgatgggttcaaaaacatatagtatatgtgcctcataagagacaaagaccaaactctagccttgggcctcctgtcctttgaagcagtattgtccttcccatggagtgatcactgaagtgattggagatagttgacaatgtacctccacatgatgtcacaggcccagtcccggtggcaaatctgcttatctgtttccaagtagagaaaagtgatcacacacaaacacacacacacacacacacacacacccctttatgggaagagaagaatgcacagttttacaacaaatagcagtgcttcatgaatgttgcaattctaaagatcaagtcaggaacctttctaaaatgaaggcaaatggaattgtatgcaggttattgtccacagcggtcataatatctcaatgtctgatattctcttgaagtttatatttttaattattgtactttctacacagcttcagcattttttttttctaaagacaaacgaataggtaggaggataactagtgagaaccgcaccccccacacaatcaccacttcatgttttctaagatgggtatatttgcaaaaacatgtatggatctaaattctcttttatatcatatccatctttctttggagtctacagtgcatccatgatcattgtgtacccctgagttactaatttcttttataaatagaagggtttgctgaagagaatttttcagtgctgatttctgaagttgcttgttatttaggtatttttgattaggtctcaagaaaaatatatggagtctttaagatgtttggaatagaagtgccttcatagctgaatgcgaaagaatccatggacacttatttgttatatatgctgggagctggtgctcggaatacctcagagaataactcacggaagtctgaatgagtagggtgggggaatactgaaaataaagtttcttgttagatacttgaactaataaaagtttctcccacaattactcagttctaacactggattaaggcacatccccctcacctcatgatatttaagtacatgtatacttgccataaatactctgtttatctgcaagatgtaattagatctctaaaaaagtgacagttcacaagacagttatgatatttcaatttagtgcaaacctgtagatttaattgcctcaaataacaacacagattgtatttcaaactcttcaggattcaggatcatctgttatatgttagtacattattacacggcatactgtaagactgggtttacaacaaacagatgcaccaaaatgctatgcttcccaaaatgtggactttagtttttacaggaaggtgaattaaaattaagatgcagatgagcttcttgatttcacagtatgttttaagtggaattgccttgggaatgaaaactagccccagcacagtagggtgactatcacggacagtattgtattttatatttcaaaatacgtaggaaagatgattttgactgttctcaaagaaattatcaacgtttgaggtaatggataagctaattaatgtgatatgatcattacacagcatatacctgtatcaaaacatcacactgtaccccgtgaatacatccaacgattatgtgtcaattaaaaataaagtaaaactttacaaaatcaaatgagctactctgaagcatttgcaatgacttcatagtttaaactgggatagaatctcaaactagaaaagggcaaggagcctgttctcactaaccatgtcactcttggagcagatggcctttcctgaaggctgcgacattttttgcatatccctttatttcaaaggctgttatggtcatgaaatggaataatgtgaggacccctaagggagctcaggcatgttcagaaatacttgatgagattatcttccaatatgaatgtgcaaggaagtgttttaattctagtcataatttaacaagatgaaatcaagctaaagatgtaatatattaattggatcttgtgtaaccactaaaagcagtgctagagacctctacatattgatgttaagacatgaacgacatgtgaatttctatgtgaaaagagcagttatgaggacggtttgtatgatagttgggttcttcctttacacacaccgtcctcatgctgtctgctgttatactttgtgtttgcctccctgcagtggcccagcctctgaaatgttttgccttcctccactccctcactgtgttctagtcccctaaaaactcaaatgactttactctgaatatctgggatctgacaaaccaattgccatatggccagtccatatttagaggagatattgtgagatctctaatctgttgctaccactattactcatgagaacaaagatccctcctactatttcttagttttttctatagattaaccttattctctggtctacaattataatcatagttttgcaaatacagattactcattctattttagttccagggtggcaaattctcaatgctatttaaacccattgtccagtttctctatatccacatccaaaagagcagaacattgctggagaaaacctcttaaacagaagatgggctttactttgtattaaaaaatgagtcaactctgtctaataatcttaccacaattgtgtaaaaaactcatttttatactgtaaagaaaaatgaattcatagagcttctttttttcctaaaagctactgaccatcctaagtacttcttgagacaagggaagactttgtatttcatgaggtaatggaagatctaaatggaaacttcctcatcctcccaacaactaacctcaaaatccatttcctcaatgtctgtcttctcattttgcccttctgttaaaattaactcagtgatctgccttctaccaatggccagtgcgttcatagtttgattcctttcatgcatacttgctcaatgatttggccatttatcccttctttctgttgaaacatacatatccctttcttaaatggtcattgataacattttataaacgtagtttagaatttctcatttttgaaaaagaaagaaaaatcttatttccttctcatttatttcctgctaccaccctatttcttctacctgttgtttttcctataccaatatttctctaagaagtcatttatatattctgtcactaacctcctctcttcattcttcaaccattgcaacttggatttctctcagaccactgtatgaagctgctcttgtcaaggtcaccaaattcagttgccccgtatttgtcttcatcttctcacctcacagcttcatttgacacatttgatgatgttctcctatttaaaacactttctggtttttggttacatctcacttttcaggattcttcctgtctctcaggctgtatttcacaatctaacttgaagcctatttttttttctattctcaatcttaaaattttcaaattccacagggctccttcactttcctttctactgccctctcctatgttatctcattccttcccagggagttaagttacaatcttagacatggtgaagatgtttctggcagtgtgctctagagctagttaaattctgggtaagcctggtgaatctaacagtaaagttgaggcatgaatctagttgctactggtaaggacttcatctctctcagagactgctgtaagcatgggtatagtgtgagaagtgggcatgtgagctgcattggctggcggcagccctcttggtaaatgccgaccaatggcatctgcccttcttctctctgtggcctgctttgccctttctgtgttgtctggtttgtctggtgagaatgtacctttgctgctataattttcattaggcaaatatttctctttatttaaacttttaggttcaggggtacatgtgatggtgtgttacataggtaatctcctgtcatagggttctgttgtagagattattccatcacccaggtattaagaccagtaccccatagctgacttttctgctcctctccctcctccaagcctccaccctgaagtagatcccagtgtctgttttttccttgcctgtgttcctaagttctcatcatctagctcctacttttaagtgagaacatgcagtatttggtttctgttcctgcattagtttactaaggataatggcctccaactccatccatgttcccacaaaacacatgatctctttctttttatggctgcatagtattccatgttgtacatgtaccacattttctttatccagtctgtcattgatgggcgttgaggttgattccatgtctttgctattgtgagtaatgctgcaatgaacttacacatgcatgtgactttatggtagaataatttctattcctctgggtatatacccataatgggattactagttcgaatggtagttctgcttttagctctttgaggaattgccatactgctttccacaatggttgaactaatttacactagcatcaacagtgtataagtgttcccttttcttcacaacctcgtaagcatttattttttgactttttaataatagccattctgactggtgtgagatggtatctcactgtgattttgatttgcatatctgtaatgatcagtgatattgagcttttttttcatatgcttattggctgcatgtatgtctttttttgagaagtgtcttttcatatcctctgctcactttttaatgtttttttcttgcaaatttgttgaagttccttataaatgctggatattagacttttgtcagatacataattttcacatgttttctcccattctctaggttgtctgtttacactgttgatagtttcttttgctgtgcagaagctcttaagttagttcccatttgttgatttagcattttttttcttgatcatgagcctgacactggtatgggtgctgggactgagacaataataacagttaaccctgacatagaatttactttgtgccagacatgtttctaagtcctgtaatacgtgaatttatttaatcctcacaaataccacattttacagatgaggacacgtagactcagtgaggtgaagtaagtttcccaaggtcaaaaggctgggaagtggcagagctggctttgcacccagaaggtttggctccaaatccttgaagtcaccagctggtgagaagagacacaacactcgctacattacaaggtggtaaaagatgaaagagaggtttggaacacgtggagctctagggaggaaggtcctttctccacctgggaatgatttccagaggcaatagccatttgggctaggatttgacatttctaacaaaggagtagaaacaatctcacaagagagaaatgcattgcaaattgcagaaacaaggaagggtgtggccatcttgaggcacttcgagactttcatggtggctagaggataagcttgtgttgcttttgctgtgaggaaggagatggctcagaatgatgcaaagtcaccagcttggccattagcaggctcagctcaagtgcctattgcctgaattaccattcttccttatctctacaaggcagttacacaagaaaaaccccttgggtgtctctcagctaagatttttttgtagttatagaaaacctcctaaaccctaagccatgactcagctttcctgcagattaatctagatgatctaagcctagttctgtcactgcacataactcaggccccacctcctattgcataccatttaaaagcagggtgagcagcaatcaagacctgctggaactgagggggttcctcgattgcattacattaagtactgaaatatggtaattgcagacaaatcaggaagaatgggataaactatctgaagtctacctgatgtgccagaaataagatgcatgacaactcataatgcaaagacgtcaaattcgcatttctctaaagtatagaataactgttaaataaatatagagatgctcattttagttttacattcttttaacctctactattctagttattttctcttatcaggtttgtgttgtctaacaggtctgcttccgagcttaacctcatattcttgggcatttctctccctatcggatatatagtcttccatgtttttgttattttctacaaaggaaagtgctctattttttgattatttaaatattacatgttccttctaaaaatattaaatatataaaaaacataacaaaaaattcaaaatcacatgaaattatattactctgagataaccaccattaataatttgttgaacatacttgcatttgtttgtgcatatgcatatttttgtatgcatgcataaaatttcataaaatcgtattattactccttcctaacttattttcccctctcatctatgtatttttttttctctttcttcctaataccatccagctgatcatggtaaccactgttgatttcttggagcatagacttcagttgagttcaggtcctcaagatgcagattccaagacaggattatatgtgaataaagatgtatttagggaattacctacacaagataaagggaaggaaggagaagttgagaggagcctttaaacaggcctgacttccatgaaggaaaagagaaagtctgagactaccgtctagttctgaaaaagtttggctaagccgagggggattcattgaaccaaactcacccagttgagtacttacaacttgaaggaatgggcctctattatgagccatgctgtgtccagtcatcaggtgctagtagcctgtatgaagagtggtcttagtatgaacaagggttggacccagaaggacagcagctggtacgtttcctgcaacccagaaggacagcttgtatgtttcctacagcagatctgagcagcatgtagcttccttcatatttgtatggcaaagtgcaaatgcacatgcatgcataatggtccttagtcattgtttttacaaatataaaatcattttatgtacactaaatattgctcttgtcactaaacagtatcaatggaaagtcatccaagtgcagcaaatataggactcattcttttcaagggacaccatactttccaatacttatatatccaaatttactcaagccatttgttattaatgagaattctcttgaggcctaaatataaagtattaaaacacttgtaaataaaaaatttacaagttttgttttgcttaaaattaggaatttaatatatatatatagtaagtcagttgtaacacttccattttccttgagcttccaaaattttgttgacatcaatttttttcattgtcatcatctttcctattaagtttatcttcaagtattcatgtttttaaagatatatatacttaatctttttaattctcatttttgctttgaggaataattaaaaataaaaatgtgttaatatatcatatttcatgatttattgttacatattaacttttaacttattttttccagtttttaaaaagttggtattttatttgcaattttatattaagaactgatttgattttcaggtgactgacatttttattattttttattgtatccaagaataagatatgtcattacttaagttcaggctatgttttatttctttcaataagatttaataattatttcctcatatgttttataactttcttattaaattaattcttatgtatatgatagtattatcacttctgagaacagaatgttttccatttttacttatattttggataagtatcatatatccaactaccttaagtgttcctttattaatttgattgcttctttaattggccatcttgttttatctagatttattatgatattttcagtaaaattatagttttatttttctttcaatctttatctgaatttattaaaaatgttaatcatattttatgtaactatagtattaatagacacttccatcttatccatatcataatagaaatggctttagtattttggtttttaaaagttgtaagtttttgtgaaatgtctcatattaaagagtatttcctctttttctattttaatttcattttaaataagaaacgactggtttatttaattaagtaatgttttatgtattgaaataattatatgactctttttctgttagtttttcaatgatgcatgagtcttataggtccctaatatattaactaaatcattattgtgttctacctggtagtatttattgaagattactgtatctttgcagacatagatctatttctaatataccaatattcctgttctataattttctttcttttactctctttactgggattgatttttcatttcatgcctgcattaaaaatgaattgataaagtgtccatctcttcctatagtctgtaaaattttaattatctttgtaattgtctgctatttaaaaagaaagctagacttaggaaaaggaagtatgttgttttaatgcctcttgggggaggaagggataaaatctttaatcatttacttgcaccttccaccgtaaatggcctatttaaatttgctgctttttgttgttgttgttgttaactttgctgctttaaaatttacagtatgccatcatttttacctggcctttaaaatgtattgaaatatttggccaggcaccatggctcacgcctgtaatcccagctctctgggaggctgaggtggacggatcccctgagctcaagaatttgagatcagcctgagtaacatggcgaaacctcgcctctaccaaaaatacaacaaattagccgggcattgtggtagacacctgtggtcccagctacttgggaggctgaagtgggagaatcgcttgagcctgtgaggcagaggttgcagtgggccaagatggcaccactgtgctccatcctgggttttgtatttcttcccaacactcccatccttaaaatggatcctaacccttgaatttcaagaaatatgctagatcccaatcacatttctcagttttgcttaaaccagatttgtctattccaattctccaccatattctctgtctcatgcagacttgcatgtgtaaaataaccttaactgtaatatctagagaaattgagaggaaaagacatagaggtgaggagatgtcagctcctgaaagatttttaaccatcataagccatttgaacttcaatatgagggcaataggggtagggcatagaactatattaagcaccaaagttacttaatgagactggtttattttaaattctctacttcttttctcttaaagtggtcgttaataacatgcatcttggaattagacaaaccttcctacatttatttgatttatgactttaagcctgaggttccatatcaataaaaattgagacactaattttgttttcacaagggacatctgaaatattacggtgctaaattatgtgcacagtgcttattacatagtaaacaatcaataaatgatattcaatcaacaatcaccatcatcttcgtcttcatcatagtttctatctctattatgttacagatataggtaaatgtggtctttttagtgaagcatatagatttttcccacagtcttgattggaaaagtgagagtatagctgattgagagaactcactgtcagctgccaaccaatacagactgttcaacttttgtttttattttgttgaaaggtctttctcttgctttcatagcttgctgtaaatactgcattctaatcactatgatataaatatttttgataaaagaattaatggaaaagtaattgtagagacaaaaaactgagaaagtttggcattaattatcttgaaacacagtcagtccctctgtcatttgcagatagtcactacttttaaaagcaaatagttctattggtcatggcaactctcagtagcagctatgagaaataaccaactcatggctgaatatagtaaaagttttttctcaatcacatcacagtttaatgtttgttgggtggctctcctgagcagcaccattcctctggagtgacgtggggacctactgcttctatctagtggtcggccttgttggaattttctatttctagctgtaagggcaagggacacagagtgggtggggaggggacacagagtgggtggggagggcaccctggctctttactccctgaatcctaacatggcacactgcacttccagtcacgttttagtggccagatattagtcacaaggtcaagtataaatgtatatttcagccttctgatatttgcacacagacttcctgagtgtgcagaaagagaaaaatgggcagtttaggaaacccagggatgtggggaggtgagtgtatacccacgtatataataagccagcaacagctaaagatttagaacatggcatccagatccatagtcattttttaaatggacaaataccatagtcattttttaaaactttgatgagattatgaatgagaaacaattgaacattattttttgaagccattatttatttatgacatttcctattcattttacatttttttcacatacgtaaaagagaaaaattggatgtacatatgcgtgcttaacagtggaatagtgttgacatattttcccctcagggtttcaccgggagttcttaactaaaaaatatgtatcctcataattaattaagaatgttattaattttgcatcaataatcattatctaggtgattttatttcatttaatcatgcaatatggctatttctacctctgagagtcagcctgttccctgagattttttctaattttttatacccagaaaacttagtatttatgtatattttcagaaaaagtattaggtgaatatttatatttttattattttattttctttaaatacaatatgtcacatacttatatatgtgatatgtttcacatatatcaaaacatcacatatttatggtgaacaatatgatgttttgatttgtgtgctataaacaaatccagctaattaatatatccatcatctcacctacttatcattttttgtgatgagaacatttaaaatctactcttttagcaattttgaaatatacagtacatcattattaactatagataccaagctaattatgaaactaaaattttctatctttttgatgtttcaacaatttcaatattttgaaaatatttaataactgaagtgttattcatttgagtatcttaagatgatatattcaaagagagatcatacaatatgataatgctattaagcatttttacaaatgttcaatgatattaaacaaattaaaattaaaagtacttctatttgtgatgagctcttaatacataaggggtcattttttgagaaacagctgttatattactttcttttctcaggtatgtagttaacagataaaagtttagataatgaataaaatctcacagatcacttttccatgtgcatacattgtttggataaacaactgattaatgatgtctcatcctttcaatcagaaatgtatttgtaggaaataaaaagtgtgaatgcttgagctgaggctgtcagtgatattattttgcataattatattttctgttgattcattttgcatatttctttggatggagcttctctgaattgattaaaacttccattttatcacctatttgaatttaatttttgctcaggaaattctgcttcgaatggacattttgatgcatcatattcataagaaaaggaaaagaaagcatagaaggtgaggggcctgggagtttccacttaccttgatccctgtaccatttatttgctggttaccagttcctcctctctgatatgtggttgggataaagttaatgggtaacctttcaggctcaacatttctcagcgtaacacttctctttgaaccatagagaaagagaaattcttagactctaacactctatcttgttgctcttaagattccaggtgaatccggacacaaagtgcctattttacacaataggatcctgttgtgctgagtgtgtcagagcataggctggcatctcatagctcttactgttaaaagaaaaaaaaatatggcaattatttctttgtcgtgagatgacattctctgagtgctcagtatcttcttaactcagcaggaatactctttgtaatatagaaagcatacaagacaaaaggcaccttcccaatttgtgtgttctttcttttaatcttgacaaaagtattgcaggcctctttggtgccagattctgtataataccctgaaatgcagagaccttgtgtgcttagatgactaatacaattagatgacagggcaaaaagaacactgttgggaacgaggttcaggaagagtttgtcataaggatacgaagtggaagggcattccccgccagagaaagcagcagcaggaggagcagacctaagatggaataatatgaacatatggcaaactataaatttcatggaagacttgaatgtgaagtgttggggaaaatgccaggtaggcaggacatatagccacaccctactacagagaatcattgtttctccttccttacacatttggtcttctaggcagtttatctcatgtacatggagagtgaatatgggttctgacttggccttgtacagccagttaatgacttccctggattccaacaccaaaagattcagtctctgaaactagttaatagataattggaaaaatgctgcaagcagttttctcaggatattcatactcaggatccaggttgtagctcctgttttgtgggtaacagccttgactttcatccttcaatccccaccaaacacacacagacagattttgatagataagccagtctccagtggcccactttatgcaatctagacacctaacagtctccttgtttccatctgaagctgatttttgttttttgatcggcactaccactctcaggcttggttgattggagaatttgtgatgcacacctgtcctcaattccagaatgctgggaaagtcattgacatgactttcttcagatgatttggtttgggccgtattaaattttgactatttcaccaccttctaatctagtacttagattcattccagcgttggaaggtatgtaattctgttgtgatattaaggtcactacagaatcagggcaaagaggagaaacacagaaaaatgaaaacaaaacacgcaggcttctaatgagaagtcgcatgatacagactttaaaagcatgggtttgtgagcaagacctggcttgaaattcctcttgttctacctcttattcgccatagagatgattgagcagttgacataactagtgacttagtttcgtcttccataaaatgtttttctacattattagcttactgtgatgaaaaaataggataatgcatgcaaagctccttttcccagtacgtggcacttaataagccctccgtgaatgttaactattattcttactttcatgatggtttgtaatcccaagaaaagataacaaccgtttttccttttggcttctttctttggttgttttattttgtttgtttgcttgttaagtgttcaatagatatttgctattttttaatataacagttgactgttcttacttttttgggaggtggatgtatgcaatgtattaaatatggtaaattttcagaatcgaagaaaaatgcttcgttataatacatcatggaatagcacacgtgtgatatcttaggtgttggaccacctgagaagtaaaggattatcctctacattttgaaaagttctgtgggtgaaaagaagaaggcatggccaaagaatccgaaattaatggattagttatctctcaaaaatggaatttagtttataaagttataattaataaaataattaataaattacccattgggacagaaagggaaaacatatgaaagacatatgtttatatcccaaaatgctctgacgaacttagatttgaaaagaaaagaccatgtcaggaatagtcacatgagggttacagatttttgtctttattatgatgtggtattttgtttggacctgagaattggtagtgatagattaacttaccaagtagtagatatttaatcaataaaaaatttttctaaataaaaaaatagtcgtctgaaacataatgggctttgttagtgggaggttgtttaggtcaatacaagataatcactggtgatgttgttttgctctgctgtgggaacaaataaattccaaagttgtagtgtcctcacagtaaaggagtttatttcttattcatgtagagttgctgtaggtctggtgactcttcacagcaatactcttccaagcgatacctgaaggatccacgctgttttcacctctgtctccaccatctaaacccacaggttccatggtcatctttgaagggcagagagagacaaaggagccccatcagttcttaattcttcatattggaaatgaagatttttatggtcatatttctgtttcctaataatatttatacttagctcccattctgtctatgaggaagtcttggaagtactattttcctgtgatataggaaacacctaacactctcggccactaaggatatttctcatgactggactataggacaatcctaaatctactgtcagaaattccgatgattaataatcagggtttgcaaaatttatcaaatgaatctttaactaaacaatgcctggaaaagagtgtttaaactggagaaatacacactacccacagttaaaatttagtgtctgcctgggtataaagaatgtattatatctggtaaacatccatccctagatacataagagcactaagaggcttctcttgtaaatctcctctgtgtgtataggtagttacacttgacatttgctttgcttgttcaaagctgtctctaatagctcagctaaggagataatatgtgagacaaatacatataaatcaatctcatatgcaagatatttctgtctctataaatgatcctgtactccttcttgccatctctaggagcttaattccttactccttcattgaattgtcctaaatcctgctggtactgcttccaaatgtctcttcagaggtagtttctttacaccattacaaatgatttttttctttaatgaaggccctcatatttcatcttcaaactaattaatgaactcatatatattccacttttttgtagcacctcttcttttgcagctgcagctgccaaaatcatacacctaaagctgaagacagtaaggaccattgtagttaagcctggacatcctggagtgagacaccctgtaaccttggacttttcttagcctttctccttagttttgtcatttcttaaatgagagataagagtatcttatgggcctaaaagaggaagataatgaaaatattatacattaaaacatcatggcacaaatgaactagaacggatgcaggccatagttggacaaatgccatacccttcattgctggatcatggaagcttctaggagtattcttgataaggaataaagaggcaaagtcatgaaggaggacacacttgcctaggttttggcagtggtcatttatcagcattacaggagcagtttagtaatttaatattagtgtgagctacctatcagctgaacatcagctttagtttagttaactctgtgaaaacactgaacacagtgtacagtcaaggctaggttaggaaatgctgaagtaacaaataaatccagatcttcaggtattaacaaaaattagtttattctagaatgatggatttagcttgggaacagagcctggagatttgtccatagctctaaagcacttctccctgaaggtggccccctttacttctgcacatattccattgaccaaagcaagtttcatggtcatcccatcattaaaagagtagagaagtactcagaagaggtgagttaggcatatcgaagagccagggtaatgtctaaatatatgatgtctagctcattgttaagtgctccagttattattaaagtgtattctgattttttcatttctcagttcaaattacgtttattggatctgctttacctccttataacacggaaactccttgttgtcgttgacactcattgtgatgtaaatcctaactacattcctgtttatatgttatactgcttcacttcattttacctttggtctgtccaagcagaattatttggttttctcatcaatgcattgtttttctctacatcactgcctctgatgtccctttaccattagtgctttaactgaatctctccatgccagtaagccttctaacatgtcaggttctcaagttcaaatgccctaaatttccattcctgatatcaacttctgtagtaatatattccgttaactcttattttgctgttagacccaacattatattatagtcatttttatatatgatgatgtagcattatagcctgaaaacttatgaagagtccatgcctgattcatcatgtagccccacttgtgagtaccttactcatagcagttcaataataatactaataataaaattcatcataatgttacatttagtggtggcatcagcctaatgtaaaatgagcattggattagatattttaaaacttctggattttatttgcaccccagttactaactagcagtattacctagaacaagctgcttaacctattggaatttcagttttctcaactctgaaatggatgagaaggaactttaactgattttccccttctgtcttacaatattgttgggagaaccaggtcagatatgagatcatagtatgtgaaagtattttacataaattgtcctcattctgatgtaccaaagctaaactctggttttaagtctacagtggattgattcttcagtagcatttaattctgtttcccattctgttttctccacggaatgcttcttagaaaacgttttgggtttcataacattttatctttctggttttctgcctatgtctcctttagctgaccagtacagctaacctttctctttatcccttctactctacactctttgctagataagttcattcataccataacataaattcccatctatgtacaaataactcacaaatatttatatcctgtcaaagatctctcatatgagtgataaatccaggttcttggttggtttctctacttggatatactaacatgtctcaagcatatcattgccaaaaccacactcttgattcacacttgccttcataagtcttgcaattttccagtgtttatttttttctgcaaatggcacaaccactttcttagttttaagtgttaaaatctaggttttctctttcttcatccacaatgccaaaagtactgacatgctgcaaaccttaccatgtgttcttattccattaatgagaatctaagccaaatccccaccctttcttataccttccaaggaaatactttcttaactggtatttctttccttcatcaatctattccctatactgaatcttttcaaaatgtaaatcctatgctattacttaaaatagttaccactgtttgggaataaaggttaaattccttaacctggccttaaagaccacatgcaatgtgttggcatctacttctgtagcctcatctcctgtcaaacataatgttctctctacaattttgtcttgcgaatactttccatagttgttatttttactatttgattgattagtcaattaaatatatatttttctcattggagactttgagtttcctgatggtagggagaggtgatcttttttatatctcacataacaagcactgtgctttgcagacctcaagtacttaataaatatttgttaaatgaataaagagtttagtaggtagacctgttttttaactgtgtattgagattgactttttaagaggtgcaataaaggcacaaaaaccataaatattaatgggcatgatttgaccttcaaggaaatcaagatctattggtaaatatgcttaaaaacagttaagattgaggggaaattttgcactaaggaagcagcaaatcttctcccggaacgtggtttgatatatagggcttgacagaagaagcttccgcttctgatctctgattttctggaggactcatatgtaaaatttctcaaacctttcagtattttctgttcaaagattataactgtctttcattgttatgtttccttcaatgtgacaggtctcagtgaccacacattcctcatatatatctcaaacctggaaaatttcagagtactcaacacattttcaactataaattccccttttctgtgcttttagatatctatttatctctagtttatgtgttgtatttttgttgtagcttgattatttctcctcgactcaatttattataaatgtttccatacataggtatatatattttagaaaatctattaatattttctctatgtcttctaggttttgtatcctgttaatgaaagcctgctctaaactcccttatttaattgttaaacatttgacatgaaaaaatcatccccttaacttataaataacttatattaatcaataagaaatatacaaataggccaatagaaactagacaagggattgaacaaaaaaggcagtagaaataataaataattttagagaaaaaatgttttccctcgcatttaaagacatacaaaacaaagcgatatgagttttgtaatctgttcaagttgataacaaatgtttcatctaggttatggagcagtatttattattatacatcactatttggagtgaaaagtagtacaaaaatttggtgaatacatcaacaatgtctgtcaaaatataaaagtacatatctttccttatcagccatactactgttgtgaatttactcaacagattattttcaaaagaatagcgagatacttctgcaggaatttctgttgtacaaccctttgaactatcaaacaaaaaatgttggaaacaagctacctatgcattaataggaatgtgattagataagtcatattgattcatccaaagaaaagtatgaagcagatcaaacagtttaaacaattgaagtggcatctgtgtgttcaagtggtaaccattaagaaacaaatatacaaaaagcccatggtgaataactagtgattactttgtataaataaaaatgtatatacaaatgtatgcaaaaatatacatgaaacaatttttcttgaaagatacattaaaaaaatgtatagacaatgaatacctttggggaggagtgcagttaggaagtaagggaggtaataactcttacttctcatttttttcatttcataactatccttgtactgttttaagtatttattacacagtatgtgtattactgtcatgttttttacaaaaataactgacattaaaccattttaatttctatgcttcacaaaaaatttctaaagctaaggattttaaaaattcttcctccttttgtggaagtgaattctatacttgaacatatttaatattgtataatgtatcctcttttctttgaactgtagccctcagcatttttttcagctcctcgtgtgttcttacttactgaatctatccttattaagctgctaattctgctatcaggaagttcttggtaagttcttggtatttaggattgtgcaacaaaaattgaagtcaactattttgtacaaaaaaaaaatcattattctacattaacagttgattttggaggtacttagtaaagtcgactcaatcatagacctccaaatggaacaaacacccttacttgcatttcattgtgatttttgcaggccctttgcagtaatagttctgaaaaacagtcagaaataaacaacttaaaccctcaaacatattttatatgctttgaatttaaagcactcatttaaaagaaaaattcaatcaggtggttttttttgtgtgtgtgtgtgcctacatttgtttaggtttcttcttttattttttatttttggcccttattcctctttcttttctactttcccagaaattctggtaaaagtaatgtaaaaaatgtgaatacctgatcagaggagttgcttaagaaatgtctcagctgaaaccagtactttagtaagagtgctagctgcttaacaagtcaagggtgtgaggagctatgaataaagagagaacattttgccatgaattattcagttaaccatgggatgctgttatctccacttcagtggcttttaattgcacatgtaagaattctgcttatctggcattcaatttgatgccaaggtgcagcttgctcaagcagggctggaggcaggaaatgaggatctcatcagacaagcagctgccattcacgaatgcattaaagaatatggcatagactagcagggaaggcagaagacagacacagataatggcaatggaaggatatgtgagaatatgtgacaagagattgtcttttccttttgatcttattgcacattgctgagtcttgagtgaaaagtcaaattgtgtgtgctacctaaatgtactgcattgcctttgttagagacccaaggttgacctctggagcaaagatgacaagttgctctttaaaccattctcttggaaaatctggtattctttcagtctaaatggagtcctgactcaattttgagattctgttggttttaatttttcaaagtttacttcagataagtttgtttatcaagataaataactttctcaaagcctttttcttatatcaaatttgcagaagagatatcttttggcacctgtgctgtaaatgtttcaaaacaatttacttataaaataccattttaaatattttcagaagatttcatttggaaccccttctccatttaaacctctccgcatagtatgtgattcctttatattattgcatacatccatttccaaattgaagtgcttatgcaacacatgagtttcatcagttaccatttgctgtgtgctgtgtagtgcataggagatgtagagattagaagtatccacagataaagcacccttaccttatggagttcaaaggctaaaatgaagatgtgcaacacaaatctgctggtctgcatggctgttgctgcatgggaagtttatgccagacaaaatggaagcacttttgagggtttgattacccaaggcttcctgggagaagggactggagaaactggaagagacctcaaaaaaggcttccttcagaagacaacatttatgaaatatgataggtttgtagacatttctaaatttggcgaaagaagaagtgcaggaatttcaattagtatagccattatggaaaacactatggaggttcctcaaatgttaaaaaatggaactacaatatgatccaaccaatccactgctaagcatatatccaaatgaaatgaaatcaaaataccaaaaagatacctgcactcccatgtttatggcagcactattcacaacagccaagatatgaactcaacctaagtgtccatcaatggatgaatggataaggaaaatgtggtcttattacacaataaaatactattcagccgtttaaaaaaaatgaaccatatcatttgcagcaacgtgggtgaaactggaggtcatataatgtcaagtgaaataagccaggcatacaaagacaaataccacatgctctctcttatatgtgggagctaaacaagtgaatctcatggaggtagagtagaatgatggttaccaaaggctgggaagcatagggcagaaggaataaagagacttgtttaatgggtacaaacatacagttagatggaaagaataagttctagtgtttggtagcacagtaaagtgactgcagttaacaatatagtgtatttttcaaaatagctagaagaaaagatttgaaatttgttcccaacacaaagaaattataaatgtttgaggtgacggatatcccaaatacacagattggatcataatgcattgtatacatgtatcaaaatatcacaagtacctcataaatgtttataattatgtatcaattaaaaaagaaaatgtggtatacatacataatgcaatactattcagccttacaaaagaagggatttgtgtcattttgataccatagataaacctaaagtttatgttaattgaagcatgttttacttaaacattatgtaaatgaaataagccaggcacagaaggatgaatatcgcacaatgtcatttacatgtgaaatttaaaaagtcaaattcttagaagcaaagagtagaatggtggttaccaggggctgagaggtgaggggattgtggagatgttggtcaatggacacaaaatttcagttagagagaaagaatgagttcaaaagatctattgtgcaacagggtgcctatagctaataattatgtattgtattctcaaaaattgcagagtggatagtgttatcaaaagaaataaaagctaagtatgagaggtaatacatatgttaattagctccacttagcattccacaatgcatacgtattttacaatatgttgtacacaagaaatatatacatttttcatctgttaaaaatagaaaacaaaaacaaatctgtaaggagaaaaagtttagtatcagaaattaaagaatactgaatttaatcataaaaatggcctctgaaagaaagttgataatcctgggggacagcataagaaaaaaagaagaaaaaaagaaagaataaaagatttagagctgtggtgacaagcttggagggttggaagaatagcaggttattaaattactttttgggacaatagggtgcacaaggcagaatggcaaacaatgtgtgaagagtgcacatggtgaggtgccaatttgtgaaatgaagtccatgtggatgttattctgaaggcagtgaagaaccagtgaataattttaagcaggagtgacgtgatcagatttgtgatgcagaacaattgttctgatgacatcgttcctttggcacagttgttgatggggctccactataaaaacgaacacaaaacaaacaaacaaacaaagaccacttcatattagcatttcctatggggccaaaaatcaaagggacaatatagattaattgaaacagcagatcatttgatatcagaagaattgggtcttgttttatgttcttccattttttagcaacataatttcggacaaagtatttctcctttcccattaggtttaagttcaacgtatgtcaagagcttaaaacaatttctcatgcatgagtgaagcttcataagtgtttggggaataaatgaatggatttctgggtctccgtattcttctactaagtaaggaggatcaaaaaaatgttctgagagtcatcttccactactttggaagtgactacaaagtgacacatgagattagaagttaagtgaacaacctatattgtatcccttcagggaaattatttttgtattaatattgttagtctggggaaagtatagtgggagaggagaaactatgaatcaattttcagacatctttttctcctctgttttgttttgtttttttaattttggcagtctcttctttcctgccttctcttttgctggatgtttttatattcctacattttaaatatcttacttccaaggatgcaatcctgggacaccttatctttttgcttactgggcatttctgtacatacttttcccccatgtacttcttttcccttatattccactgtgctttccttccttaaggtctcaaaaaaaaataattcctgctcccctcccctcctagacatctaatataatctttccaatgggcctgagcttttccaaaaggcaagcagaaccatttaattaggttgtgtttagtttctgcccagtgaaagtccctgaggaaaggaacacaaaagcaggctgtcacattgaaatatgtgagggttcatagttggggaaatatagaaaaaggaaatgcttataacttaatttattggattcagcatagttacttctttgatattgttttgaagaacttgatgtgctagacaactgccttttgtgttcaatctaccatctgaagtcctcacttctttactgtaattgctgaaaattctaacccccaggaaaggggacaaatttcctgaggattttatcttgtaaactcttgcagcaccagtccctagcccagtgtttgagacataataggtttgttagtaaataaacaaatgtctctaggcacatgctgatggcttatttttgcagaaggctgaagctgctgctcaggaatttgctcatcatcagcttccttctagtgacacctatatcttcaattgattctggactcttcatctcaaagcaatgagtgacttttatttgccagttctatgctttggttaatagttttccaacgttttattattttgttcctctaatttctactttttttggttgcagttattcaagagattgtgactaaatgctgcattcttagaaatttcttctctgaatcaacctctagtttgaaatgcaatatataattcccaacataccaagatcatgtgtcttattcctttagataaagtttactatcttaccttgtttcaaaattgtgagcatgacttttataataactctgcattttattacaggagggcaggtaccatgctgtgatcttcctatcctggggcctagcacagggcctaacagaagtcgtcaatatgtgtttcaattgaattaaattgaatgaagtgtaatttctactcaaaacttttatagttataggaataagaacaaattttacaaaaatcattgtaagttacaaattaacctaaaattacacagtcatatatatctagcaggagaatttagacaaattctatacaattaaaagtaaagttgaatatatcattgatatttaggtattatttttctgagaagagaagcttgatcatatcagaaggatccctacatttaagagaaaataatcccattgttttgttgcactagcttaaaaaaatctttctatgaccttgaactcggtaaacactgaaaaatgcaaagtgtttcctctcaagggcctcttttatggatgtttcatgaattttcgggatgatgctgttcatctatgttaatggattagaaggaccattgttctaaacagtgaaagataaatatacagtccctcataacagttttgacctaaacttttgtcatatttataggttttcttcctctcaacaatttattttctctcatggctttgttaaattaggtagttttattacaaaatttctttgcaagctttttaaaaagtctcaggaaactgatcacgacaaactctagtgaaagtctttatttccatggtaaccataatatgctctaagtatcttctcatgaagaggtagaaccaatgttaccagcaaaacacagacaaaggccaataaagaaggaacacacaaacacatgttcattacagcaatggtgatcagggctgcagtcaccctcctttcaatatttaattcattaacgcaagcagattttttaatagtataaaaacaaatggagaaaagtacaaaatatgcagtgacaatttttgatttagaataaaaaatgttaaatgccatttattgttaagttcttaattttgtaagaaaatattttctgacatctaggctaaaatatcaatgaaactcaagtttctctgatcattgatattttagcctagatgtcagaaaatattttctgttaaaaccccgatagtaaacaggtaagataagactctgaaagctatatggtttctgtgcggactacttggcaataagtaaacaaataagtattgctgtgttacaataaaactttattttaaaaaacaggtaatgtgccagaattgccccttgatctatagtttgccaatctcgtttattataaggtaaaggtagtattattcatattctacagatgagcaaatggaggttctgagaatttaaacagctcaaggtgaggcagaatcagaacacaaaccaagtctattgcattttaaagcctgactcctaaatagctacgcttatttaataagaatagctggcatacactggtgcctaatgggacaacagtgtgctaaattgtttatgtccattactttgcttaacttagaaaatccctgtgagataggtatgattagcattctctttttatatatgaagaacagatacttgggaaatctaagaagattttcgaaggtcaataaaatagtaactctatctttgttcaaattaacttattctacttaattcagtgactgaaataatgaaatcattttttaaatgtgacctctatgatctcaagaatataaaaaggaccatgcacatttaaagagtacctgagttctggtggatgctttgagatttgcaatgcttatttctcaatctgcagctttactttgattgtaacttggtttccattcagtctactttatgaggtgtaatttcatgaagaggcaaaaagggtaattgtagtgtgcagttaattagaatttctaattaaaatcatccttaaaaaaaacagccaatgccaatggaagaatgattactaatctgtaaattaaggaaactgtatactgcaagattttttttttctactggattgaaaaacacccagtttaagttaacatatcataaataaagataatcaccttaaataaaggtaaaatgcatagggcaataggttgatttaatttggccaaatgtaattcagttaaatactggggattctgtaactaacaactaatcttgcttcacttcccctccacagccttcaattccttctttctaatgtttgggcacagatttgattttctcaaataagggctcagtaaacctgtcaggctttcacaattccattcgtatgtctatacacaagcacacatgtgcgtttgcgtgtggttggcaagaacacatgtatgtgttaatgcatgcctgtgagtgtgtgtgtctgtgtgctctgtgacatatgggtaaaatttgtagcatcttgcttgatactcacaggttaacttcttgcttcaactccatgttgtagcaacaaacatttccccataatctcatttcaccaggtgtaggaaacttcaaactatcttaataacttaagaatctttctgaagtcatgcagaatctgttcattctgcatttgtggccatggttacataaaaaagtaatcattgggaaaaaatcttatttatctgtatagtaatagtcaaaattttgggtcaagctgtctctgaaaattatgctaagagctttgatagaatatcaatacagtcactccttggtatctgcagtatctgtgagggattggttccaagatccccaaggataccaaaatctaaggatgctcaagtcacttttataaaatggcataatatttattataacctatgcacctcatcccatttatatatctctagattacttataatacctactacaatataaatgctagctgaatagttgttatacttcattatttattggtattattattttctatgtgtgcttgtttgaatccacttatataaaatctgtagatatgaaagcctactgcatcatgtttactttttagcatgctaaatatgtaaatatctttttgaaaattaataaactgtatattttcgagcagttttagatttacagaaaagttgagcccaaatacagagttcctatataatcactccccccccacagtttccactattattaacactttttacaattgaagaacaaatatggaaatattattattaactgaagtccgtagtttccattagtgctcactctttgtgttctttgggttttgacaaacacatgatgtcatgtatccaccatcagagtataacacagaatactcacatttccttgaaaatcttctgtctttcatctattcatccctccatcctcccctggttcctggcaactactgatattttttactgtctctatagttttgccctttctaaaatgtcatatagttgggatcaaacaatacgcagtctttttgggcttatttttatcacttaatgatatgcatttaggattctctacctttttttcatggcttcataggttattcctttttagctctgagtattatccaattgtatggatgtaccatagattgtttattcttgtttatttattatttgcagttcttctattgaaggatatcttggttacttccaagtgctggcagttatgaataaagctgttagaaacatttgtatgtaagtttgtaagtttgtgtgtgtgtgtgtgtgtgtgtgtgtgtgtgtgtgtacataacttttcaactcatttgagtcagcacctaggagcttgattgctgacagtaagagtatatttagttttataagtaactcccaaactgtctctcaaagtggttgtaccatttacattcccaccacaatgaatgagagttcctgttgcactatatgcttgccagcctttgttgtctatgttttggattttgatcatctaataagtgtatagtggtatctcattttgcaattcactaatgacatgtgatgttgggtatattttcataggcttatttgccatctgtatatctcctttggagaggtatttgtttagatcatttcccactttttaattaggttgtttctttacttattgttcagtttaaaaaattccttatatatttttcatacaagttctttctcagacagatacgtgttttgcaaatattttctcccagtgtgtggtttgtcacttagttttcttaatggtattcttcacagagcagaagttttaaattttaattgatttaaacttaattgataagtcccacaccaatttttttctttcatagatggtacttcatataaaattaattgcccaaaattatagagatagaaagtagaatgatagttactagaatatgtgtggggatgaggagaatgggaaattattgttctatgggtatagagtttcagttttataaaatgaaaagaattgtggagataaatgttggtgatggttgctcaatgttattattgtatttaatgcaatagtacaacattttaaagtgtacacttaaaaatgtttaagatggcaaattttgtgttatgtgtattttaccaccaaaaaatttggaaaaaacttcttcccaaacccaaggtaacctagattttttttccttgttatcttatagaagttttatacagttttatattttacacttagatctatgatctattttgacccaatttttgtgaacaatgtaaggtccgtgtttagatacactttttttgcatagagatgttcagttgttcagacacatatattaactttttgtttgcttctttattgatatttatagtatcgaatcaatatttccaaaataagaagctcatcaaatgcctgtgttttagggttcttctttgccatttccttattgctaggaattcagcatctaggcactcatttgaatggatttgtttgaatatttatactcgtcagcaaaaaaattcccttttcagtcttagttgctttggctgctacgaacagggtggattcttttgagtatatgagagtatttgaggtcatggatagaagagcttcattattcaaattccatatcatcagaaaaatggggaaataaaatgggaggtaaggatacatatctcttattaagtagctttgggagatgtcagaatataccacatgtaaacttctgttttcacaaagggcagggggatgagtgagcacagggacctgccacagtttctcctatgtagcttctgatcatttctgttaaatggtatggctcccttcttgcactattctttaagtcttctcagttagatcattcttggacatctgttcagcttaaaaatcagatgttctggggaaaatacttggccaggtttgtaacaatttcatcagagatagtgctgtttttaaaggtaattacaacatatatctgcatctggacaaggaccaaaaaagaatgcagaagagggaaaaatatctatatgtgttgtgtgtgtgtgtgtgtgtgtgtgtgtgtgtgtgtgttttatacacatatacacatgaacacacataaatgtttagtttcctcttctttcctaacttgaaactatttatgacaaaatagtttacatttatatagcatcatggtcaaagtgctttacatttaataatttatttaatccaaagtggaaagaagctcccttttttaaattaacatcaaagcagtttattttcagggtgggaattcaaatatttgagcatactttttacttggcaagtcattttctcccctaggacagataagaggctattaaatctagcacagcagactgagaattcagcaaatcaaatgacagataaggaattgaaatatgagctgcatatcaaattctgaatttaggcagtttggagaaagaaatgtttcaatggttttaatgggaatttgtgttttaaaagggtgtgttcaagaaatactgggaagaggattaaaaaatagtgacaaaaataggtgaggaagaaaagcacatgattgaacattagaagtaaatgcctaaaatatctgtacttctcagttttacaaaacaatcaatagtaaggtgatatgagaacattctcctttagctcttgctctattaaaaaaataatactgattcagtaacagtctaaatcccaagtgaattttctccactaatgccataaataactcacttcctgcaggcacatcatttttcactgttgaaaattaaaattgttaagtagagtattggcaagagagaaaataagccaagctttcataccttgttcttgttgcttctatatttacgtgtgactgaatttggttggatcttaagtatttggtactgtgtttgtcataactacttgtaaacctatgtcttctagtttagctttaaacattacgcttgtgatttctataaaaaccttcatgttttacaagaaatgaaatgtgttattttatattattttgcctgtgacatggaactcccaagtatggttatttttggtccataagcatgctactcatacagttccacaggaccccatgctaaaaagggccttccactcggttgagtgctctgccatcactattaatttttgaacaagggcctctacattttcattttgtactgagcctttcaaatcacatagctggtctggtatgtttgaataagaagttcagtaacaaatagaccaaagtctcaatctcacccctgggccttgcagccaaatgaacatggaaaagctaattggcactagtgagcctattctacccttatttataacccttatttataaaataaggattaaaactgtctctctcaaaaggctataatgggaattgaaaaaataaaacatttaaagagcctcacaaataaggcaaatacgtttttgttgttgttgatgtttcatttgaatttatttattttttgagatggtgtcttgctctgttgcccaggctggagcgcagtggtgtgatctcagctcactgcaacctctgcctcctgggttcaagcgattctctcacctcagcctctggagtagctgggattacaggagtgtgctgccacaccccaccaattttgtatttttagtagagacagggtttcatcttgttggccatgctggtcttgaatttgtgacctcaggtgatccacctacctcagcctcccaaagtgctgggattacaggcatgagccactgcacctggcctgttttgtttttaatctcaggagccaactccattaaatttgggtggcttcctggtaaacttcagccagaaaagctaacgctaaattcttatctaggcaatagatattaatgtgtataaattaagccacaaattattgggttcatgagtaaaaccttactttgaaaaactctagcttgaactttgcaatcctcactttcctttgggaatgaatatttttatttttccacattctctcctgttattagggcatcaatgttagttcataattgttgcctttttttctgcttaagtgatctcctatcttaataatcaaaacataatttgttactttggagaagggcactcaggtgaaaaatgagaatgcagatataagcatgatgctttgacagaacgccagccattgtcttttagcattggtttcttatgaacaatatttctgtgctatgactggcctcatttgaaggtatgttctgtatgggaggtgaaggacacagtgcttttggctgcagaaatctggagagttggcacagggttttaaatgagggatcaagatttactggaggatctcttccccaagcaattgttgttgctgttgttgttgttgttgtttgtcattgtcttttttggggggggaacggggggagttttggctgtatgggtgagtataattaataaaaatgcgtcgaagactgcaaataaatgagtttatgagagggaagaatgtgcaggtaattgtgtaggctagcccagagatatacccagctctgctctcaactcataaggttttttttttaatcttaattacttttccaaataagcctttctaattgaaaaagtattcttcaacaagaataattaaaactatggaacatgaaagatgggtaattagttagctcattcatatcaattgacagatgaataaactgaggtcatacaatttttagtggactaatgaaaataagcagaaagtataacctatctgaactctaagtctgtgtgagtttaggttcatgaacgagtttccccagaacttaatcaactgtgcactaaataacatagacttttagttctggagggcagaaccagccttgagagttttgttaactacagatttttactgtacactgtcctagtcacagaccacccacccctcttctccggctacacagtagttacctcctcctcatgtgggcctgccagatccactgcagattcttaaatagccattgctgtaccaaatgaaattctatctgagaacctgttttgagggtattatttcttctctacaaccttgtggccatctcacctacactctctaagcctcaattattcatctgtaaatttagcataatgataattatctctgctcagcctccttcaaagcactgaattaatggaaagcttagaaaacatacactgaagcactttttagtgtgctctatcaattgaatattatagtgttcatattggctttttataataggtatactactattattgatattaacacaataatgtgttcaaactattgaaataggattacttaaaaactgcgttaatattcaatagcttaaatctgaattgtaattacttttagaactttatacactaagtgatttctaaagtgactaaaatagggaagaatatttcttgttttgaaggagcataatgatttgcaaatcatggatgataggttcaaagaaaaataattggttgaaaaacaaactgttgggtaccatgctcactatctgggtgacaggatcattcatactgcaaacctcagcatcatgcaatatgcccatgtaacaaacttgaacttgtacccctaaatctaaaataaaagttgaaattattaaaaaaaaaaaaaacaagaaaacgaaacaaagctaaactgagaaatatttaggaatatgtttattatccttgggagaagacaaggagaagctgttggctgtttgatgctctaacaaaattttcatcaaaaccgtattcccaaaatggccttgaaaggcaactacattgactgtcaatgataacagcaggattggacagcatggttgttggttacttacagtctggaaccagaatgcctgagtttaattgctggttatgccacttatcatgaaatattaagcaaaatacttggcttctctgtggtttaatttcctcagttataaaatgaggataatctaattgggttgttataatgagtaaatgtgaaaatattgcttagaacagtacttggtgttttaagtatttattaaatatatttcttaactggtgatcaattagattctattcaccatctttattttatcttgtgtttagttgcttttgaaattagaaaaataaatcaagtagcatgtcatcatatctatacaatacatattttttaaaatgtggacatcattcaaatgctcaggcttgtagaatttatgtatattgttaacaattttaatgattttgaatgtaatcaaaaagatattttgaagaggaaatggattggataattgtgatctgttgattttttcatgctaaaaaatcatgttttttcatgtttttcatgttttcatgttttttaaatgatactgaaatctttgcattaggacaatgtttctcaaaatgtgacccaggaacccctcaggtgtccatgcctatttcagagggttcacaaggtcaaaactattaacaaaataatactaagatgtgatttgccttattcatgctcattgtctcacaagtatatcatatttttccaagattacatgacctatagtattacaaaagttgaatgcagacacagatctgagaactcaactgtcttccattaaaatagtcattaaggatattcattaaattgtaaaacaacaccactctcgttaattttattttgtttttgaaaatgtatttttataaaagtatatgctattcatataaacatgatgtgttagtactatacattttaatgaagtaatacataaatatttttaattttcaaaattttaattctttagattaattattaatagatataactggcttaaacaaaagctccttggcatccccagtaagttttaagaatgtaaaggggtcctggaaaaaaaattaaaattactgcattagactatctgtagtctcttagaaattcatcttgggcaagtggtttaatggagttgcacaagtctgtggaacaaccaagaggtaggcccaacatcatccaggctctccagcccaatcttctctggatgaatggaacaactagcttctgtgtgttgtttctttcagttctagagccgctgatatgacagatggacaggccatgaatcagagagcacaggggttctctgtttagagtcagtaaaaacatgaatttgagtgacatttttcaaccagagctcctgatatttggaagctggcagcaatacatatttaaaacagtatgtaggcacagagagaaagtaatgtgaaagtgtaaatagtcgatgtgatgatactcagagatttaaaaattatatttccattttgaggaaagtagtttttttgtgttgttttacaagattgaattgctacataattttacaagtcatatacatgtgtttatatacatttgatagttcactataattgcaaaaattaatttagcttcccttggaattgagagctgctgggttcaaaatttggcagacaagtacaagtgagcacaggcctacccaggacctcctggttccaaagtgagcacaggcctacccaggacctcctggttccatccttttcccagctgatatggtttggatatttgacccctctaagtctcatgttgaaatgtaatccccagagttggaggtagggcctggtgggaggtttttggatcatagggagcaccatcctcttgatgatgagtgagtttttgctttagtagttcatgtgaaatctggttgtttaaatgagggtggcaccttacgcctcctgcctccttctcttgcccctgctcttaccatatgacatgcttgctccccctttgccttcctccatgattagaagcttcctgaggctctcaccagaagcagatgctggagccatggttgtacagcctgcagaactgtgaaccaattgaaccttttttttttcttttttgagatggagtctcgctctgtcgcccaggctggagtgcagtgggacaatctcggcttactgcaagctccgcctcccgggttcaagcaattctcctgcctcagcctcccgagtagctgggaccacaggtgcccaacaccacgcccagctaatttttgtgtttttagtagagatggggtttcactgtgttagccaggatggtcttgatctcccgacctcatgatctgcccacctcggcctcccaaagtgttgggattacaggcgtgagccaccgcacccagcctaaaccccttttctttataaattacccatcctcaggtatttctttatagcaacaaaaaatggcctaatacatcaaatttctaatattagcaaggaaccattcccgcagagttggcccagtttcccagagccattccctcattcaggctgtctcatatttggttatattagcctcagatgttgaccagtaattaagcttatatttggttctactctttacaacatggggattgctggcctacgcattgcaagggagactcacctcctctctgcgttaccccagtgctttcttagcacccagactctctgtcagtctcccttaactctgttctctcccagatcctgcttggaaaattgccgctgttcatatcaattatttttcagaaaccatggatgcattaccaaaatgtagataagaaatggtaacgaaagcacaacccaaggcattcattatgaggttagacagaacctctttctttggatgctaaagcaggcacctgggaaaaacaaaataccaacccaaaccctgaagaaatgtcactaattaattgaaggtgtatcactcaattcagaattgagacatctccagctgcattttcaaccagatgttctttcaggcatgtagtgtcactactagagagaaacttcaacagtcctgattctcataatgagtctattgaaatatcaggtgggaagccttccaggtgtgagatcacattgctaaaaaactggtaatgaggggcaattctgcttcatttcaatatttatatagcttgttaagggaactttctactaaagacacccctcggagtctaaaaaaaaatgcattaagtaggtggacaggggctttgattttccctccctttgaggggaggtaaatgcatagttccacaagcttagaatacaatgaatcaggtaactgagataatattatcttctgcactcacactaccacaggattcactttttcatgtatcatatatttgcaatttcccattgactagggtaattggcaattcctgtgagctaacttaaaaatctgtttttctctttaactaaaacatagtataaaatcaggatcaaatatctgttctgcaactgtggaaatggcttatttccagaaatgtttaggatgtataatagtttgtacccagatgtagttatagaacagtcactgaaaaatggttgttttcttgcatattatttcaacctcccacccatgttaattgccagtgacattttgggttgtttttcaatactttaatgagaactaaagcttctgaaggagtcttgctgtatctaccatctgattgaatttgatgtcccaattattgatgtctttgccagtctgtgaaggaaacccaacctccaatgggtgaagtagcagctaggttaggcagatattttatttaatttttagctctagcaaaacttaacggtaatgatcaagaatcttgtaagtatgaagtattaatcttgaataggcatgtttgtacagagttcatgtctctgtatctgaagacattagcccctagggtaatttattatgagacacactgaaatttaagttgtataaaaacaagttatcggaggaagctaagaaggcccctaggtggagcagaggtactaaaccctcagcttgataaatactgaggagggaaggtcattacaataaatattgcctactcaaaatgtgatccatggacctgtaggatgctgtagcattggcttctaccacgggcttgttagaactgaatctcagtccccctgctccccacagacctactgaaccagtttaacacattacccataagatttatatagatgctgcaaaactccattaacaaggggttgtggtgcacctgtgctcagcttgggctgtagagtaccagctggcatgataagtgaggcagctgggattctgattctgacactgttgatgctcaacatcaggtagggaccaggttggtgtgccacctagatcttgcagtttggaaccaaagatttcaatgaattgccaaggtgttgggtgcaaaggaagtcagtatcaaagaaagagaggttccatccatgtaggggccacactatggccaagaacgctgtcaggctttagttcattaaattcagggctacagaccaagatgaatgagtcattgcccattccatcaagacatcaggtgattaaaacatcaagataaaaatggcctcaagacccatccacacaacatgggttaaggcaagagtcctggggtttccctgaggcacatcagctgtcagtcttggggaccacatttcatattcttttcactagtgggaaagggtttctcaggttctcctgagcatacggcccgggtgacgggcttccattgagttcttaaagcctagaagacaaggattaatgtcccaacctattcagtttaaagtggaggagtgcagcaaactcaatccaaaaaataatatccctaagaaacagtactttttgaaggataggcatcccaaattgatattttcatgaatgaaatggggaaaaaatgataatgatacaaaatactaatgcaactgtgcggtttaagtgcagtcaaacttggcaggatcccatgataaacattcatagttttaatggcatctaaactgtagtaacaatcaacgagttagtaaagcttgaaattagtaaactcaatttgattcagagtttgtggtgagcaattctaatacttgtgtgttcttaaggaattacctttgaattttttcttttaaatatgtcaaggtcttaatagtattgactttctttgactgtattatctctttgaacccttgcgtcaacactgttaaataaataatcttagccttatgtttaaaattaggcttagagaggttaagtaactttcccaaggccattcagtaaagtacaactcacaaaaaccttctgaaaattttccaattgactctgtctactattccccaaggattttgaatctcattacttaggcctttgtgagttatcaaatcttttaagcaaaaaggttttctttcttcagtcacttattcattcagttacttctatcttacagggcctggggacctgtaggtaaaaaattgtcacaaaacaatgtttctttagctttgatcccattctgcagagaactctagtttttctccagtgccaacaaagcatttctgggaaacaccagaggttttatcctttgtattctgaatgaatcccatttgctaccacagattgtgtgacatttctttccttttatgcttaggttttctgtggtcactgtggattaataaggataaacaaaacttccaaaataaatacaaacaaacatgtaatggctcagtgaaacataagattatttatttctccctaatatagttcagagagcttccaggtaaagcagtgggcaggaagataggggttctctccacatttattaagggattctggatgatgtcagttttgccatctttaatgtgtgatttttaaggtcttcctgagggtcaccagtccaatcggctaaaagaagagaatatgaattgagtacatgtggggaggttttctggggccaggcctggaaatggtacagaggatgtcctcttacatttcactggctagatctcagtcacatggcaaacaatttctaggcaggcaaagaaatatggtttgccttgtgcataagaagaggaggaaatgcatttttcgtgggtagcttgtactctcagtgagactactcatgtgccaaatggaagccatggtaccagcacatagcagaggcagtcactgccactgctcatgtttataagatcatttcccctgctgacagtcatcagccaagactagaatgcccacattcaatgaaaatgtgaccctcatgcagctatctatgctgctgactccatgcctctaccatgttcagctgagcttgtggagattggaggaaatagacgattaaatgttcactgctgttttactaaagaccccttgcctggacatatatctaaatgtgtatatgttgagggattgtcagctgggacaggggtttaaacccataaaagtgttctgtgttgtcctccaaatcatgcttcctttctaatgcttgggtgaagcagctttggctcagacttagacacttgcttaatatcttctaggtacttgaagagcttatggcccaatgggactaactgatgcatatacaaaaaattacacaatcaaatctcaatttcctactgtttattcttcctttgttaatttctcactctcttagtttatttgaattctgctaccagtttgtctgtcccttccctttgaccctgttgtttgcactgttcttagagtcaagatttcagtgtcatgataaaggaccagctcatcacataataagagttgtaagagtagtgacccaagaacatataagggggaagttctctactgaagggtctgtgaaaatttgttgccccatggggctggaccaaagccttgctattgatcttactgaacaggtcactgttggtcaggaatgtgataaaaaggctgcagttaataccaacaaacaaatattatttgtaacatgagctcttgagattatggtagaaatgtcacagtctgtatttgcatttgattataggagctacctttatttataaagaagcatgctgtagtgagaattctttgctaggagtcagaattgggttcaagttactattgaccacacttccagtatgacctcaaagccattaattaacatttctcggctcatttttttttctgttaagatgttgaaataacacctacttcacaggcttaatttaagaatgaaatgtgataatatatacaaaacacttagcatagtgatccattatgatctctgttattactatcaataatttggaaaaaatagatacctacttttaagaaataccttcatttttgttttttattagccatgtaaataaaactatcaggtattaaatattacatactgacatatattgaacatatatgtctgttttaatacatatatatttctttaatatatatgtgtatatatatagttctttgtttatttttagtactgatgattctattataaaagttgtagacatttcatttacaagtcattttagacctttaaaagaatattttttaagaatgtgtaaaagccagactttctttgactagatgacttttattctagaactgatttttgttttatgtcagactcaggacacatttgatttatccttaggttgttttctgaggctttaaagtatcagagctgagtggaaaaatacttcttggaaaactgattttccaactaagaaactcagagtgatggattgctagaataatggctgtaatatatactgagaatacaaaggagatatgtagtctcttcaagatgaatttgggttcataagaagtgagtctgtgttttattatctttctgcatataagaaaactcagactatatcatttctgcacaaattcatggtagcccctgtctagcctatccagttttaatatggaacaataaataatataaagaatatcatggtaataagttttttgtgttctctaatccagaaaggcattgttgccataacaagttttgtaattattggagaaaagtacaaggatttctcaaaaatcatttaaatggtaacatttaaatgttaagcactgctaagatgaacctaaaacaaatatttaaatatctctattgttaatggttattttaaaaaaatttctcatccacactactggtgcttatagatactatagccacaaaataggtaatactaccattatgctaatctctttgaatacattagtttattgaatattttttatcttttacaattatttcctacatctagcaaagatgtctagattctagctgtagcctcttgcctctttctccattcctgggtcttacttatatacaatttctcttcccatggccctcagaaatttttttttagacccctgcatgttcttactttctggctgcatctgctcttatatctttttttaaataaggtgcctttggaccctaccatggtatcatggtcatcgcctctcaaaaaaaaaatctgcatttgatgtctttgacaatagaagaatgattgtatgaaatgaatatccaatttatttttctttttttcattttcctttttatttatttatttttattttttagagatggggtcttgctatgttgacaaggctggtctcaaactcctggcctcaagtgatcctcccatttcagcctcccaaagtgctgggattccagatttgatccaccatgccccacccaatttatttctcatgattccaaagtttatgcatagatgctttagctgaacaatagttccttctaattgaaaagaaagcctctaactcagctgacatggaacagtctcctgcatgtagtgaacttactcactacagagggattgatgctttcagagaatgacttaaactatgacatgctgtgatgagtatatcctcaagctactacgacatgtttattaacctctgttacccaattaggtgcaacattgatcagaacctgacttcaatagttttgatacttagtcttttagctctgactgctttagagtataaggtccttgaagataggattaccaccttataaaacagagttgcacaacatagcatgttagaaataggttggggccaggcgcgatggcccacacctgtaatcccagcactttgggaggccgaggcaggtggatcacaaggtcaggagatcaagaccatgctggccaacatggtgaaactctgtctctactaaaatacaaaaagattagccaggcacggtggtgggcgcctgtagtcccagctactcgggaggttgaggcaggagagtcgcttgaacccgggaggcagaggttgcagtgagccgagatcatgccattgcactccagtctggtgacagagtgagactgtgtctcaaaaaaaaaaaaatagattggaacttttagtcatattcgttcagcttgaattctagttcactagttgtttgcttttgggcaattcatttaactgctattagactagccaactagggacagtttttgttccttaagtttccaaatggttgagaggctcaaatgagaaaatagtgccaatacagttcattaattttatgattgtttctggcatagaaggaaatgaaatatttaataaataaacctatgagtgaattgatgaattaatgagtggtattcaaattatacttttaaatgtatgtttaaatacatgtggcatcccatttcctaggcctaaatataatgaacatgcttgcttgcaaaaggagccttttgctaacttcccagagagtctcatacaatcagtcagagacaaagacccggtagccgcttcaggagcctcgcatagcaagtgattcctgttgttccactttgtgcttaaagcatgagaagttgggccagagtagaattggaaatggaggacctgtaggccaggctttgcttttaggggacttgtgattggcaattcgttgcagataataatgagaagaaggcagaagattttaatgaggcacgcatgtgagaacctcagagactctgggtaacttcggtgtctgcaaagtggctactccctgtttctcaagataagaggggaaggtttttccatttcaaactggttgggctcattttggtcaggaagagtcttggatggagaaaaaattccagccctgaggaaaaggcattcagcagtccctggtagtaaggtaagggttggtagcttaatcaactataggccacacagaacaacaacaaaaaaggggctttagcggtatgtttttacctagtaaaagaaataatttcacttctcctctctaccactctctttaaaaactcatcctcacaggtgtatgtaagacaatctgagagtggaggccagtgttttgcagtgcaaatccggcagtatggcttgctttgagaagtctatggcaatgctccaagggaaaagactgcaaaagtcaaaatataaatatattcagtgacttcagatcccattgtttccaggtcccttttgctttttccaattacctgtctcatttttgaggaaactttgcagtgcttttccttttattgtcattcttccccccaccctgtggtttttctaacacctgcactgcatcatccttcaagacccttttggctttgtttctgtgcatgattatctccccttctccctccttaccatatgcgttttaacaaaaccaattttcagtattgagttgaaaaaccctaatttaaagaagtaaaagagatcttcccaaattttaagcaaccgtaaagaaccagctggaaatgtatacatgtgtgtatgtttgcatgtgggggagcagtgaggatgatctctagagatagattagatataggaaggatttggcaatatacatgaggttagcgtgagaggaaggtaagtttaaatttacagtagatagccatttccaaggatgtattagaacaaatgcagaatttcagaggaaagaacagataattatttcacggcccttgaaactccttgcacatttctagcttgtaaagagaatgcagattagctttttatccatacagtaccttcatctatcaaatatttctgtctttataaacctacaaattacatacatacaggtctgggcttctgggtgaattagaagcaggggcaggtttcctcataaaacctaactttgtcaccaatttcatgtaatttgctactaaactgtgcttcttttgctttttatctctcttcttatgtgctcttaaaagctacttgctggccgggagcagttgctcatgcctgtaatcccagcactttgggaggccgaggcgggtggatcacgaggtcattagatggagaccatcctggccaacatggtgaaaccccgtctctacgaaaaacacaaaaattagctgggcatggtggcatgtgcctgtagtcctagctactagggaggccgaggcaggagaattgcttgaaccagggagtcggtggttgcagtgagccgagatcgcgccattgcactccagcctggtgacagggcgagactccctctcaaaaaaaaaaaaaaaagctaacttgctttaatctatgaccgtgaccttacaatgtactttataatgcatgtaccttgatgataacatgtgatttgtgatctttctaggctgacaaatgaatctcctagagctctgctgtgttgctacagtggtctgagtcattgtgattagaaattatttaaattcatcatttttatagacaggcctgaacaacctagcagagtttttttaaaaaaattttactcaaaattaaatatcttattttgaaaactgtccttgtactataatagctagcagacgcttcaaatatttctctttcatgtagacaaatctatacatttctcctcagagaatatagatgtcaatgcctgcagataagcaatccaaataagtttaatggaaggcagttttatgtaattaagttgtgacacttttctgtgtggaggaaggcttaaaaggaaggaaaacaagccacaaatgggagaagggcaatatgcacacgaaggttgtgcctgtggaattgaacattccttatctatcctttggttcttcaaatagttcatatctcttggacacatgacattgagaagtctggtaaaaaagataaagcctgccatagagtagcaagagaaccaagcaaatgtaatgtcacagaagccaagaggagacaatttcaccatggagggatagaaggatggagtgattgtctatatcaaattatgcttagaaaaaagataagaacaggtaagtgaccctttgctttgtgaaatactgtctctggtgactttgataagagcccttttattggagtggtgagtatgaaagtccagttgaaaatgatgagaagaggccgggcactgttgctcactcctgtaatcccagcactttgggaggccaaggcaggcggatcacctaaggtcaggagttcaagaccagtctggccaacatggccaaatcctgtctctactaaaaatataaaaattagctgggcatggtggcgcacacctgtaatcccagctgctcgggagcctgaggcaggagaattgcttgaacacaggaggtggaggttgcagtgagccgagatcataccactgcaccccagcctgggcaacaaagggagactccatctcaaaaaagaaaaaaaagaagaaagaaaatgatgagaagaagaaaactgaaggtcagtaggtatggcagtgagtataatcaaattagtcagggatttttttctgagaataattgagaactaaaatagtggctacagaaggagacaaggccagttatacatatgggaggacaaaagtgaatatgtgggcttcaaaaggaatacacatttatttttcattttaatattagaaaaataggtagagataaatgcaagttggtggaacttgtggtggaaaggtgaggctcttttcttagtcatggatgcagctacgtcattagcagagaggagaccaaatagcagctggagatttgaagaggggatgagtgatggaattgtcatctcagagagttttaacgttcaaaccaagtataaagtacattaggtacaaaggcagtagacataaatttgtaaataagaatacttagagactataaagaactaatcaggccgggcgccggggctcacgcctgtaatctcagcactttgggagaccgaggcaagtgtatcattgagttcaggagtttgagaccaacctagccaacatggtgaaaccccgtctctattaaaaatacaaaaaatagtcgggcgtggtggtgttgcacgcctgtaatcccagctacttgggaggctgaggcatgagaatcacttgaacccaggaggtggaggttgcagtgagatgagatcatgccactgaactccagcctcggcttcagggagagattgtctcaaaacaaaacaaaacaaatcaaaataaagtgaaacaaaacaaaagaatgaatcaatccaaaccagaaatgacatggaaagtagtggtattagaatgatattaagcatcagttccttttaaatgtagaactaaaatatctcagagctgtccaatgtaatatgaaaatgctctctgcattctctacttataatacttaaaaaaatagtgatattcaggtgtcctctgatgattaccatatttctgtttacatgatctaattgattgttaagcatctagtataaatttgttgaaatttttgacttgtggatggcatacttcccttattcccagcacagatagagggcttgtcttatttttaagtgcctttgcctgtttcaatagctgtaagtatcagggggaaatgaacacagctagaaatctgcactcaagtgttcatcctgccagtagttgtcatttaaatcaatgattagattttatcttattgacgacacatattaacatgtataaattctgaaaaaaaatgtaataattacaatttccttaccctatttcaaacagctgaattgttttaatatactattatagtcctttttttggaatatattgtattgtatagttagacaaatttgaattataaataaaccagtatcttatttatttatttgctattttttgagacggagtctcgctctgtcaccctggctggagtacaatggtgcgatctcagcgcattgcaacccctgcctcccaggttcaagtgattctcctgcttagcctcccaagtagctgagattacaggcatgcaccaccacactgggctaatttttgtatttttagtagagatggggtttcaccatgttggccaggctggtctcgaactcctgacctcgtgatcctttcaccttagcctcccaaagtgctggaattacaggcctgagccactgtgcctggccatatctcatttatttttattttttttaatttttattttagatttatggggtacgtgtgcaggtttatcacaagagtataattgtgtgacactgaggtttgagcttctactgatcccatcaccaatatagtgaacatagaacccaataggaagtttttcagccgttaccccacatctgcctcccaccccttttggagtctccagtgtctgttgttcccatctttatgtccatgtgtacccaaagtttagctcacccttataaacaagaacacacactatttggttttctgtttctatgtcagttcacttaggacaataaccttcagctgcatccatgttgctgcaaaagatatgattttattcttttttatggctgtgtagtgttccatggtacatatgtaccacattgttttcattcaacccaccattgatgggcacctaggttgattgtatgactttgctattgtgaatagtactgtgatgaatatgctagtgctgatatctttttggtaaaatgatttagttaacattgtgtcatcagtattctgagtttgttcatacacttagtaatcactactgatatttgtaatgttgaatataggtttccaatttgtggctatcacaaaaattccaaaatgaatgttttcaggcaaataactttttcatgttggcattgttctttggttagatttttcttttcagaattgggagtactgaatcaaatggcatgactattgtcatgcttttaatgtattttttcaaagtgttctccaaaagctttgccatcttacctctactggcaatctattagaatcttaattttattatatcaatatcagaattggacatttggatgtatctgttggatatacaaggtattcatttcatctttgtccttaatttctcggtggaccttcccactgtctgctactgtaagaaatgcattttttaaagtatggtagatagagtgtggtggctcacacatgtaatcctagcactttgggaggtcgaggcggaaggatcacttgaagtcaggagtttcagaccagcctgggcaacacagtaagacaaccatctctgctaaaaaaaaaaattatttatatatatataactatatatacaaatatatatatataactatatatatataaaactatatatatatagttaactaggcttggtggtgcatgcctatagtcctaactattctaggagcaaagatgggagggttgctcaaatccaggagttggaagctgcagtgagctatgatcatgccactgcactccagtatgggtgacagagtgaagccctgtctctaaaaaataaataaacaataaaaaataaagtggtttgaacttagtatatgcaattctttttaggcattttgttattaaccaaggattaaatgtctagtccacagtcgactatccgttttttgaaattttcccattaatatgtttcttctctggcctactgggtttgcaaagagatttgtggtaatgattctatgcctgcattcttgatatcatgttctgtatcccatgcttgtttaatattcttactggaggtcaaggaatagcataaatttcttatcacatcacagtataatgctgttaatttcagggaagatgtaacatactaactgttaaagaatgatcctctacttatagtatgagtggaaattcttatacatagattatatttattaaattattatattattttcaatatactcttagctttgaagataagtaaaactcaattaagacctagactccaccacttcctagcttaaatagatatttgtaaaattatccaagccaggaaaaatgaaaatatgaaaatgtatgaaatacaaaatctatgtccacctaatatgtttttttgagaattgaatgagatcatatatgaagacccaagcgcagttcctggacacaataagtgctcaataactattagttatctggctctccattctcttgataagaaatggacaaggccattctcatatcacaattctgggatacacatgagtgaaatcctgcatcttgtcagccaacacaccttggccatttgttactggaggaggcctttggaatgacaggagggcataagagtttgacaatggttctgcaatgcttgcctaaggagacaatgagactcaaccaattccagtttgcatgtggcaaaataagttaaaaagttgaaaatttgagttgatgaataagaagtagaagggcagtcagtctaacaaattggtaaatgtaactagccctttgggtctaatgttggaatctggtacttggaagatgtgttattgttttgttatttgtatgtacattattgttcttccctgattcagtaaattctgtactagctatggtaagtgaaacagagggaaagcattggtgcaattttgccttcatgggaattagcctacttttggaggctagcttgaggtgtcattgggaatgtggctgctagagccccactctcgggaggcaaaatcagtcacatttatgtaactgaccccaaatcaaaaacagttactccctcttttttattcaaaccatattgtatcatgagtaaggttgcttctgtacatgtcctagaaagatactcctcatttgtatagtcacaaaggcaagagtctcaaaactggtcatctttgaatatcacttaagctttcttttatggactaggaaacaattgagcggaaacatgtggtcaactctaactgtagtgcagtcagaaatcccagtgtccacatttcctgcagggtctgccctagtactttccttttacttatgaccacccacagtttcacctttgaaagccaatgtttggtgtgcaagcgtaagcttaagagaaagaaaaagttgatgctataataaatttatttctgaaaaaaaaagtctcaggtgaagttatttttagataatatatttacttgttattcatgtgaactgtgttaaaaagttgcttttatgtaggattaatttaaatagaatacttggataaaatagataaaaataaaggcaaaaaacttgtcttttctctatacacatggcattggatttcatacaaatgttatgtttgaaatgaaagaatatatttaaaaaataatagcctttttaaagcaattttaggtgtatggaaaaactgaatggaaaacataaagagttttcatatgacccttaactgcctatcggttttccctaacattaacaacttgtattagtgtggtgtatttgttataattgatgggccaatataaaaacactatttttacctaaaggccatagtttatgttaaagttaattatttgtggcatacattctatgagttttgacaagtgcataatggcatgtgtccaatcatacagactaattttactgcctccaaaatcccttttgttccacctattcatccctctctccttccccctgaacccttggcaaactgatatttttactatctacatagttttggttttttccagaatgtcatacagttggaatcatataatatgtagccttttcacactggtctctttcaccttgcaatatgtgtttaaagtttctctatattttttcatggcttgacagcttatttctctgaataatattccgtcgcataaatgtgccacagtttgcttatccattcacatattgaaggccattttggttgctgtcacattttggcaattacaaatacagctgttatacacatttgtgtacaggttttgtgtagacaatttcaaactcatgtttgtaattaccaacgagtgcaatgtttggatcacactgacactatttgacttgaggacatgctatgaagctgcaataatcaagacagtgtggtactggagaaataagagacaaatagatcaataaaacaaaatagagaaccaagaaatagaccacaaaactatagtcaactgatgtttgacaaaagagcaaacacaattcaatggagaaattatagtcttttcaaaaaatggtgctgaaacaactgaacttaaacaggcaaatttctttttcttttttaattttcttttttccatgagctagtgcagatggcattgttttaatttcaaatccctattgtttattgctggtgtataagaaagcaattatctttcgtatattaactttgtgtcctgtaactttgccatagttgcccaattcacaaatagttctttactgaatcatgtcatctacaaacacaggtttttctcctcaatgtgtttacctttcttttctttctttttttcttgtgtcagtggattaactaggaccagtacattgtggagtaggagtggtgaaagcatacattcttactttgtttctgatcttagtgagaaaacatgtaatttctcatcattaagtatgttgttagctataggatttttttgtagatattctttaccagtttgagaaagtgtacctctagtaaaagtttttgaggttttatcatgaaatggtatgataaatattgttatcatatccattcatgatgttgaatagtgttaaatgctttttactgcttttactgcattatgatataatcataagattttttcctttaacccattgatatgatagattacattaacagattttcaaatgttgaactagtctcacataccagcaacaaataccacttgtttgcggtatagaattcttttactacatcagtgggttcaatttgctaatatttttgataatttttatatatttgtaagaaatattagttcatagctttcctttttcataatgtctttattgtgttttgatattagggtaatgctagtctcacagaatgagtgagaaagtattccttttgcttctactttttgaaaaatattatagagaatttatgagaatttatatttcttaaactagtatttctttaattggtattgcttccttaaatgtttagtaaagttcaccagtgaatccatctgagctggttgctttctgcttcagatggtattaattattgattaaattcctttaatagatataggcccatacagattacctatttctccttctgtgagttttgacatagaaattttcacaatactcatttattatctttctaatatacatgggattataatcatgacctctctttcatttctaataatagttgtctttctttttcttagttaaattagctaataatttatcacttttatgaggtttttcaaagaatcagattttctctgttgatttcccattgtcactttcatcaacttctgctctaattttgtatatgtcttttcttcagcttactttaaaattaatatgctcttcttttcttagtttcctaaggcatgatcttagactattggttttagatttccttttattctactatacacatcaaatgctataaatttactgctaggcactgcctttgctgaatcttataaattttgataaggtgaatttttgtttagttcaaaatattttaaaatttcttttgagacttcttctttgactcacgtgttatttagaagtgtggtatataatcttcaagtgttttgggttttccagttatctttactgattttcaatttaatttcattgtgatctgagagaatacttcacatgatttctgttcttttaaatgtgttaaggtgtgttttatgatccagaaagtgatttatcttggtgaatattctgtgctgtcttgagaatatgtattctgatgtgattgaatgaagcattctgtagatgacaattagatctagttgattgatgttgctgttcatttaaactatgttcttactgattccctactgaaaacaccagcacaaggttaacaagaattacaagcctgactttaggaaaaattagagtcaggcattggacagggtgtgctggtacactttgacccacttccctgcagctgctgcataacccagagtcacatagcacactaaccacctgctccttcattgttcctatagatagaatctctgacaccgaacatttttacccaaaaattgctaaaggtgttcttcatatcctgaatttcagcagaacagcagacaccaagcaatctgaaaacccccaccaaggaagtgactcagcaccaaaacgttgtttcttcatctccctgtcctgtgacttcattcctcacttcttgaccaatcagcaatcccacactttggcccatcacccatctaggccccttaaaaaacccatccccaaacctcttggggaggcagatttgaggttccctcctgtctccttgtttgactgtcctacaattattaaacgctttctctgctgcaactcccactgtttcagtgtattggtcagttactgtgcaatgagaaatcaaatctggaggtcctgtaacactatctgccatatctatcaataactgttagaggagtattgaaatcttcaactataatagtggattgatacatatttttatagtaattatattagtttttgccttatatattttgacactgttgttgggtgcacacactctaaggaatatatgtcttctcagagactttaccccttcttcattatgtaatgctcctctttatcactgataattctctttgctctgaagttgccttgattggaaattaatatagctgctccaggttgcttttgattagaattagcatggtacatttttctccattcttttacttttactctatctgtgtccttattaagtggacttcttatagacaatgtataattaggccttttttccccactctgacaatcttagtattttaattgatgtatcaaacctttgatatttaaatgatgatatagttggattaatatctaccatatttgttactgttttctatccattgctcttgttctctttttttcttctttctttctttttctgccttctctggttttaactgagctcataatagagttcattttcttcctcctctcttagcatattaattatacttcttttttcctgttttctgtagtagttgccctggagtttgcaatatacatttataaacaatccaagtcctatttaatataaaacaataatatttttttgtattgcaagtactttataacagagaagtcccagtccctcccttctagcccttataacattatgttcattcatttcacttttccatgagttacaatgaccaaatactttgccattattatcttgacaaactttaacctgacagatcaataagaaaaaggaaagattttatctttatgtattccttttctaatgctcttcccttctttttatagatctcagtttctgacttataccatgtaagtttcttgcaaggcaggtctactattaatagcaaaaaatttcttcagtttttgtttgtctaagaaagtcttaacttttgaagacttccattctgaataacaatgtcattggatacagattttagcttggtgggttttttgtttcagcactttaaattctttcctgcacagcttctgttgaatgtagaagagaaatttaatgtagtacttatctttgcttctttttatgtaaggtgtatcttgcttttttcaagatttttctctttgtgtttaacctcctgtggtttgaacttgatatgctcccgtgtagacgtctgtgtctttctttatttttatctttcttgatgttccctgggctttctggatctttgattttgtttctattaatacttctggaaaattcttgattattattgttttaaatatttccttggttttgcctctcctgctatacgaaatccctattgttgtggtggtaaattgtttggggagggaaaagttaggtttataaccctatggttagttaccattcttaaagtgagactgtgtctctgggctgtcacttctacaatttgttctcaacccctcttcccttttaggtgataaaagaaggctggagggagctggagttgggtattgcccttcctccaggtcagttaggctctggtaaaatagtttgtcttaagggtacgccttgttaagcataacagaaagctctgtgtatttcaaatggctacttcccctgccccctgactcacacacacaattagaagcaccaacatatttttctttaaaaaaaatgtatcacccctccccctcaggactgggcctccctggtgtttttaactctcaagcttgtccatactgagccttgaataatttgtcaattacagtttaaatgttcctaccctgatagccctcttgattttaatttaaaaagaagaaaagtactgtacatcattatataataatgtctcccttctttctatgaagagatctcataatcctttttttactaacactttaccatatgtgattgacaaatttatgacgttagaaaaggaagacaactttgaatgtatgcaaagaaagatttggagaatcaaagtaacatattcaaaagcatcactaataagctttgttagttccttggcttttgtttgtaataattttgtatttaattagaaaataacgtgattctatccttgataattgagtaaagagccattcaaagagtgccaatctatggaccaggttttgattagcactgatttggtatgtagctttattgaacttagcaactcttctaggcaagttcaaggggcctgcttacctctgtctgtctttcaggactacaatctattcagaggaaaatctcaccttttctattttacaattgctgaagtgtcattttctgtatcagagtaatggtgctaatcaattgagaagatcacaaaactttggattcaaacattaacaagttatattgtgccaacagattatattttccaaaaaaaaaaaagagagagagaaaattggaaaaaaaaatagttggaaaacatgtgttaaacctcataatcaatctggtaatagaattttcatgattgtaccaaaccttatttcaatgaaaagccaatgtaatgtaactacattaacattcaattattctttattcctcatcgtaaatttagaaaaggtcaaaagagtaaagaagaaagtaaaattaatgttatcccacaacccttgtatataatattagttttccatttatatcacaacaaattaccacaaatttagcaacttaaagtaaaacaaaattattgtctcatagacctttaggtcagaaatctgggtgtacttggctggtttgtctgcttagagtctaccaaggctgggcttttatctagaggatctggaggaaaagctgctcccaggctcactcagcttcctggcagattcacttcctgatggctgcagggctgaggtccctgtctccttgctggctgtcagccagaacctctctcaccccatcgagggcccctgtattccatgttatatcagcccctctgtctccaaaccagcaaccagggcttcaaaccctcctcacgcttcaatctcttctgcctccaatttcagtaaaagcgtagacttttaagtgacttgattgggacaagctggacaaactctctactttaggatcaattaattatatatgcagagaccctcttgccgtgtaaagcaatattcacaccggtttcagggattagagtgtggacctcttcaggggaaccattctgcctgttatcacattttaatgtccctcaattttaggatgtttaattcattaacatataattcctttaaaaataggaattatactggatatactggtttgtaattgactttttcatgaaacaatgactggcatcgctgcatattttaatataatgtgctcagtgttcattattgtccaagtgtcaagcccactgggatgctcttggctaagagtgaagaattccacataattttgtacccctaatacttaaagcacaaaaattcagaatgacttagcatcttaaaaaatctggaagatttagtgttggtcatacaaagtcacccttactcatttgtattcttcttactttcttgagaagagacaaagacctaaggtctcattccaggagttatgtatgactttgatctgaatgtcattcagggtatacatcttgagaaggaaaagattgagaagctttgctttactctaaactgagatatggtttttaatgactgtgttgtattcaattatgagaaaggacaaatattttaaccaaatctatattttggaaataattaataatatttggtaacaactcaatatttttttgaacatagatccttggataaggccaaaatataaatattttaatgattataaatatatactatgtagctgctatctagaatgaatattctactttaaattctcactgattttatacagaaacacctattttactctgtcatctccataataaatgatgaacatactttaactgtaacactggcagatgtcttttaaagatatttggtatcttaagtagttatttatccttagattgcaatgagttttcatcgaaactgaatttttcttcttttaaaattatttttttatttttcatttttattttatttatttattttattatactttaagttctagggtacaggtgcacaacatgcaggtttgttacataggtatacatgtgccctgttggtttgctgcacccatcaactcgtcatttacactaggtatttctcccagtgctatccctcccccagcccctccacccctggacaggccctggtgtgtgatgttccccaccctgtgtccatgtgttctcattgttcagttcccacctatgagtgagaatatgtggtgtttggttttccgtccttgtgatagtttgctgagaatgatggtttccagcttcatccatgtccctgcaaaggacatgaactcatccttttttatggctgcgtagtattccatggtgtatatgtgccacattttcttaatccagtctatcattgatggacatttgggttggttccaagtctttgctattgtgaatagtgccacaataaacatacatgtgcatgtgtctttatagtagcatgatttataatcctttggggatatacccagtaataggatcactgggtcaaatggtacttctagtcctagacccttgaggaatcaccacactgtcttccaccatggttgaactaatttacactcccatcaacagtgtgaaagcgttcatatttctccacatcctctccagcatctgttgtttctgactttttaacgatcaacattctaactggtgtgagatggtatctcattgtggttttgatttgcatttctctaatgaccagtgatgatgagctttttttcatgtgtctgttggctgcataaatgtcttcttctgagaagtgtctgttcatatcctttgcccactttttgatggggttgtttttttcttgtatatttgtttaaattctttgtagattctggatattagccctttgacaggtgagcagattgcaaaaattttctcccactctataggttgcctgttcactctaatgatagtttcttttgctctgcagaagcaaattcttaacgttgtatgtcttcctttcttccttccatcttgccttccttccctcattcattccttgatttcctcctcctcttttttttaattgcttttgtttaaaaacagcatagtactatggttacaaagtagatagcaagatccagtaaaaatcaatgtgatgttaaatttaaaataaatttgctattattctggatccccaaaataacaatattatatgtgactttataggaatataggaatgctttttgaattagcagaaaaacatatggcattaatgtgcaaggaagaattatgccacatactctaaaagttctcaaaattgatatccatgaatctttttatctgtgcagtttaaaatgaatgtctttttttcttttgaaaattattttactgagatatattgattttatttttgaagtactggagtttcccaggttcctttaaactttcttcttagatttgctacaagatttttacactgtcatatttttgtaatgtacacttgaaatacatatgcaatgttgttaagtctacatttcttgttttgagaatttgacattcaaaatatgtattagtgttctaaaatatgtttctgcctccaaagccactgcttagcatggctgggtgttacagaaaatgctgtgtggctgtgaagtatgaagcattactaatatctcttagaatataaaatgaatttgttttctaaagtcaatgtgattctaggtcctcagaatttttatatagctacttagatgacagagttgtagttaatagtttgagaagtaggttttaatatctgtggtattgacatagttgttactcagtagattacaaaaaagaaaaatcttgtatccaattagaaataaacattctgtaagaatataacttcccagttagtcttgggagatggcagttcaagaagtactttgtgaaatattctaaaggattaacatagttcatcattttatgcaatggcaatacatatattatacaatacattcctatttttactcatgtagttcttcatataatgcatctaatattttaagggcttatatctgtaatttgactaggtcatttgtttagttatatttgaattttcagacaatcattaaaaaattgtggaagggtcactgttttattctcttattattttaaaaaaaataattaattaattaattatttattttttccatccagagtaattttgttttaaagttgtaggatgataatatttttacatctgtcacataaaattaatatttttaagcaatgtcacattttgaattgtattacaagtcaagaaaagatgttattattttaacacatgatattttgatattatcccaaatagatacagttgtgatattttcatagtttaactataaacatattttaaagtgccatttatttttattttattttattttattattaatatactttaagttttagggtacatgtgcataatgtgcaggttagttacgtatgtatacatgtgccacgctggtgtgctgcacccattaactcgtcatttagcattaggtatatctcctaatgctatccctcccccctccccccaccccacaacagtccccagagtgtgatgttccctttcctgtgtccatgtgttctcattgtttatttatttatttttgagacagagtctcactctgttgcctaggctctagtgcagtggtataatcctggctcactgcaacctctgccttccgggttcaagcaattctgcctcagcctcccaagtagctgggcctacaggtgcccaacaccatgcctggctcatttatgtatttttagtagagaagaggtttcaccatgttggccaggctggtctcaaactcctgaccttgtgatccgcctgccttggcctcccaaagctctgggattataggcgtgagccattgtgcccacctggggcactgttactttaacaacagaccatgtggaccactttgttgagcactcatatttcatgggaggcaagtttgaaaatttttattttagtgcagatgtgtacagcagcattttccaatgagtttgacatggttatgctctgttcgaattatgtttgtttatttcacaaattacaggtgcagcagtataaatactagagctttatgccgctagctcagaattaatttttacaaattggaaaatgttaatacattgatttttaaaagttgaatttaacaagcatttatgagctctaattttgtgtattagaagaatcattaataaaataaccagtacttattgagcactaatatgtgcagtttaatgctttattaatgatttttttaacagtcaaggaaactgaaattaacaaaatataagtaacttgcatgaatttcagaagttttcaggtaatagaagcaagattcaaattcactttttactcagatctcacagtcttaacattattctactctactgctctagaaacacttgttttctcctgacccttttatcccattcttcacaaactgtcattctcaaatttcaatcttcatccaaaacccgtagaagggtttgttatataaaacacaggatattagactccagtcccaacagtttctgctagtagtttaggtgcatacctataatatatatttccaaaaaaaaaaacctaggtgatatcaatgcttcttatccggggaccatgctttcaagaccactgcctacagtttcccttatgtttattgataaaacgggtggtatccattgtttgagttctattactattctatacacctgttctagttaaacaagatttagacacctgtgagtccagatgtcactgatttgaagatgatattaaatattctagtaccttcttcaaatgcttgttaattacctatcacataaaagtcctaattgattaatttattactcattaactggcagagctgtttcagtcagtctagactagacatagtttgcgagtttagaaatgtattctggagaattgattgatatgttatctgattataaaaatagaaataaaagaagaggtctggctgccgagccatgtacatatctagtattccactgaagatgcatggaatataattgtatattcattataattgaattattgtatctattttttcattgttaatggtatattgtttctttattacttcacctataggctattggataaaaaatgtttactattgccctttttattttatactttgaggtaaagccatttctacaaataaacaatttcttgtagtgtcttaacatccccacgtggaatgttttttaaaaatcatgtagcttattctaaatctattctaggcaaatgttaaaatcattttagttagaaatagaatgggatcaggcttcagtagatgccattagaagtggtggtttgtactaggaaggattcttcacttctacatctgtttaataagtttcacactttaaaactcattttattatcacaactgaagaaagagatagtaaaaatgtggagggatctaataaaatctagccatataatatttggagagggagatgggaaagggaaggagagacaggtaagacgtaccattaaaacagacaagcacacgataattcatggatgctgattacctgaccttttcttgcagcagactactcctgtgagacaaaaaggctagtaagaatacctagaatgtactttagatattatttttgagcactaatatagttagcctcaatgataattgcttttaagcaggccacacatacgctacacacacagacaaacaaaacacacattcatccacagggatgactgccatgtgcaaacatacactgaaaaccttctccaaggcaatgtccttcaacatcttttaaaaatgcattttaattgccattgtaactggaaaccgtttgcactcaaaattaaaataatcttcttttgctattcaggatatcgattatgttatgtcctatcacttggatttaattagatgtattttttttccatgccgaaggaggtaaaaccttagatataaatactgaaaaacaagcaccaatatttcactcatccagaaagaagtggctttccacattattcgcttgtgtacaattcttttttcagtttttctatcttacattaaactcatttactcataacatatccaagctgaatgctgcttttggctagaggtaatggtgtaagcactttttcctgccttgttaatcccagccttccacatacaagaaactttatttgaaatctgatctcacactgaatattcttattcttatctcaggtgtcaacattatcccatgtcccatctcagagcatcacatcttacgtgatcatattgtgataaatcatagcgttctacagtatgttctttgtttttcttatagcattttattgttgtactgtatttgttaaaaactgtatcataatacgtaatgtctgacatcaagagatcatatctttcctgaactgtttgcttctatattctgtaccttatgtctctttctgtttccatcaatacctttcaggcataaggaaaagaaggacactgattttcaattaatagtctctggcccaaaccctctattaggtacaaatatattaaatagatcatttttctcaacctatgtcagtgtttcataaggcaggaattatttttactttgtatatggaaaaaaggaaaccctgagatgctaagtaaattctttggtttgttaaattgaatgtaaaacatatttctgggcatacgtattgggggattggatagtccttgttttttctgagtgcattggttgaggagaatcctttgccaatatagtaatgcacagaggctctgcctatgcaaccttgaagaccctccacatacatgcacacacacaccactcacacacacaccacacagacacacatacacatacacacacacaaacacaaacacacatcacacatatacacacaccacacacacacaccacacagacacacatacacatacacacacacaaacacaaacacacatcacacatatacacacaccacacacacgcacacatagacacacacacacacagacacacacacacacaccacacacatggcacacacagacacaaacaccacacacagacacacggccagccgaagtttggagaaggaggcagcatggagaaaaggggagtctgacaccagcgagtttgtgaggaaggggaaggccaaggacttctaggggcaccgggctctgacataaatgtctgttgggggtgaataaagtcctgctgtgtaaaataggctcctcttgaatgccctccatatgaagtcatcctatgaagtctaaaaagaaaatcacaaattgctaagaaagatgaagtttcttaggaaaaacaatgtcaaaatgagcaccttgtactgcctggcatgcagtcaggacgaagcagtgggacgcagtctcttaagtgtggggccgtagtggaagccacggccagttggcatggaaatcacttcattctctgagccacacagaaagtatccccaggtcttcaattgtgttttgacagctacggagcagctgtctactccggcaaatgcgtctaatgtgctgtgaagattccttaattctgataattcactgctcttataaaaaagtcatgtaaaataaaatatcatttagggagagaatgtagcttctcatgaactctggtgaggacccatttcctggcctagaagttcacctgtgatctatgtcccctgcccacctgggctgttgggacttctgtgggtccactgcttacccagtgttttagacagatttcctccaaattgctccattttctctaacagccctagcattattgtgattaatttgactgcaattgagttttattacgagactgaaatttgtctttgactttggcagggaacttgcctctttgtcatcatcatttctagccagccagccggagctgtggtgccagacagtgcaagcgacaatcagcctacccagattgaaggtgtgtgtgtgtagggcctgcagagagggacagtgatgaggcagggagacgggggggaatttatgcggggagttggtccaatagtcattagaaaatagtcacaggaggacaatccaaagttgaatgaagtaagagcatcacttggtgactgacagttttaattaattcattaggaaagagtgtacctaaattatcttgtaccatacctgtctcacactgtctatcctgagtcaaaccaattaaacatttaaacataaaatagggtgatatttcattaagcataataacgtgcatttctcagctcaaaaatatgtcatatcaccaaacgttgcagaaaaatgagcaaatgaaataaatatggaatccacaatagaagaaaaattataaaaaatatataaaaacttccaattccaaactttacagaaattgttaaataaactatatttatattatgaaatgttaattattcattaaacccccattttctgaaaattatggtgtcataattatataatgatagtatgatattgagtatgaaaagtatgatattaaatgatataatgcaaattttgcaccctttttatggacgtgtttaaagtttgtagcagtgcaaaattttaacatatttctttctgaatggaggtaataggagtgatttttttttttatttaattttattttgctgtgatttctaccaggataaaggtgtaatcatgtatacttagaaaaaaaaatttaaattcttctgcaaatccaagaataagtggaggtttggcattaccattagagatttttatttttatctatcatgttgggccaaagtattactgccatttttttccatttatattttagtatagttccaatatttagaaactcctttaatgtaagttagagaaaattggacatataatatttaggaaaaagaaaatgcagtgtaaaaaataaagaataaaaaagttttctctagaaagcttgaaatctggcaccattatgtgaatatggggcaggggagcctttaataccagtgtgagctggagagcaggaggggtgagcacaaggcttgataaagaactaagactctaacccatacattctgcagcaagatttcttctgatctttatgttcctggggaccatggaaactagccaagggattggtatttctgcatgctaaagtgtagcctcatgcaaacctttaaaaagaaaaatacctgaggaaaaatgtgaaatttctcaatttcagatattcaagggcttcctgattggtctccctgagatcactcaccttttcttggatgatcaatattacaggataaattgtgtttcctaaaaatgtttacattgaagtcctaatctccagtgcatcataatgtgactttagttggagacatatgtttaaagcggtaataaggttaaggtgaggttatgagggtgagccctaatctaatatgactggtgtcctttaagaagtggagatgaggacacagacagacatagaggaaggatcgtgtgaagacacagggggaagacaaacatccacaagccaaggagaaaggccttagcagaaaccaatactgctgaccttagacttctagcctccaggaatgcaagtaaataaatttgtgctgcttaagccaaccaatcttggcagtttgttatggcatccctagcaaactaatgatgcaggagtttttcttaaccccttcatcggacttgtgacacggatgccccatttacttggcctgtcatgctcaacctcttgtacaaagaatgcactttgggcaccagcaagagcaggcttcatgtggaccctgaggcgatggtgcctaggtgggggtgcctgcggcccccaaagccccagagggcatattacaatgctctcttagctccaccgtctgtggacattgttatgttatcagctcagtgggcctcttgccttgtcgcgtggggctgctgctgtccaccagtgagggcaaaggactagtgtgacagccttttttgggtacctacacttggtgggtcctgagctcttgtccagcgtccaagaagaatgaggttgcacggacacttgaaggataatggaggtagataattttattcagcgaaggaaatggctctcggcagagaggggagctggagaggggatggggcaggcagataatcttccctgaagtctggccctctccggctggctcttccccaaagttaagccatctctcctctgaagcccagccatccctctgaagtcaagtcacttctctccagtcaagctgcttctctctctctaccaaatgagtctgggtctttatagggcacaggatgtggggcagaacaggctgtagatagttttggaaaaggcaacattctattggtaaaaagacgttattcaaaaagaaagaatcaggagagaatgggcaaacagggatagaagttctcactttgggccacaggtttcaggcttttgacttgatggtggggtttcaccagggactcacccacccctgtctgcccagaatttctgtttcctgcctctatcattaacacaaccaccaagccatcctattcacctctgccttataaaaatatgaaatactagctcttttcctgttctaaaagtgcttttgactggtctctgtggtctacagattaataataatctctatatgcttattagaattggcattatcaaggatattacatatatatccttatttagtatttataatatcttagtgagatagagattttaaatttcattttagagtaactgagcttaattaattgcccagtgtcactatgaacaagtctcccagtgttgagatgacactttcattttagtttttattattcaatgtgtaaattaaaagagttggagtcttgaaggtttgcggaacttgaagtattgtcttttcaaggttttcctattgtgctagttaaaatacttattgaccaggatgaagtcagacctgctgaagtttacatcaaggatggtggagagaaattaatttgtgggcctgtctcatcttctcctcaacaaaacccagtatgggggtcttggagacaaacagacctggggaaaattcctgctgtaacaactgaccaactctgccatctggcacaatttctcttagctgcagttttgaccctttaaactgagaataataactagtttatggaggtgtgatgaataaatgattggctgcatgcaaaacagcagagtgaagtagaataagcagtgcgtgttggctgttagtatcatctgatatcatgtggggatgatcaaaagacagagagcccactaaaaagtactttctcaatgtctataaaaggtaattgatttaacttgaaatagtttagactggggggagatagtaaaaatatcatttcatcttcctcatagacctgagctgaagctacccttactaacctgcttttgtgacggaatcaaagcttacttaattcccaaggtcaggcagctactaactggtacagtaaggtagccaactctggcaaccgagttctacattttcacagctacttcagtcaaatcctgattcaaggctgttaactttcacacttctcaagtgtctgtcttgtttcctcagaaccaagccagtggtagataacgtagaaaccatgtaataaccgtaattggcaaggcttcacttttcctacctcaagttacatgtcaccacaggatatgcaaggaaaaagagaattttccagttccttttcccatctgggtcagggaatggccaaaaaatgatcacagctgagaaatttatgtccatgtttaacatccttgcagagcctactttgcaaggaggtaagactacctgttgtcactggtattttcttttactaaaatataatttcacatttagaagctaataaggacctgaaaagttagctatgctatttatcataaaggtaatactatttttttgcagtgatggtgcttcctttcctgattttgaagtagattgtctctaagaagagaaatgatattcccctgaaaatcatatggccttcaggaggtgggggtgggaggtcatgaggttctttggatttgtgggaaagacgcaaagataatatatcaaagaagttaatgaaaatcatttacccagatgtgtttatcaaagatatagtgtttattcattacctctaccacacaccccatttcaaatcatttcttaaacctaaaaacagaaattatacacgcacagacggcctctaacttatgacggtttgacttaccatttgttgactttaagatggtgtgaaagcaatacacattcagtggaaaccatacttagaatttttaattttgatgttgtcccaggctgtcagtaagcagcaggatactctcatgatgctggcctgaagcagtgagccacagctcccagccagccaggcaatctcaagggtaaacaactgacactacactctacagtgtgttgccagtgtgtttgtgttatgtatttctgcaacccatcatgtctataaaacatccatctgtggcagtactcaacacattattataaaacaagcttcgcattagatgatttcgcccaactataggcaagtggaagtgttctgagcatgtttgaagtagactagcctaaactgtgatgagccataggttaagtgtattaaatgcattttcagtgtgtgctattttcaattttggatgggtttttttttttcaggacataaccccattgtaagttaaggagcatttgtattatttttctagcccatcatctctgccagatattttttaatctttgagattcccaattttatttgactatttcacccagggtaccactaatcacaatggcaatgccaactgaattcaggcattctattgtttctctttgctctcttttagcaattaaagaaggatataaaacttgatactttgggacacttcgttttaaacttcgggagtaggacttaaggattctgaagctgaggtggtaacagctatatatcctgccagaattggtctctgagccccagcctgcttctccatcaagtcataaaagtgtgcgttctgtgtactattgcctttaagggtctgtctgaactacttctcccagaactacttagttcatttatctcttctccagtgtggactctgaatcagatttgctctctgccttgttcccaggattttcagatttttacttgcttctcatttattcatccatcccacactttggcattttctatgtgccaggcattatgatggacttcagggatagttacatggctcaacaagatagacatggacccagtcttcctagagttttcagccaaattgtagtacctgtgagacagaaaagcctagcacctcttgcaaggcaggaagcaaagtagaggagacagaaatgtgcaatgtaaagccttttccttccaaaataaggagtggaatttgaaaataattatgacatttatttttaaatatatagtccctacccagtgttctgggatatatctttgacatgggcaaaaacaaaaacctcagcttcagccaaaacaactcattctatgcccctagtctagattattgcattttcttaccccaaatttacatacaattcttcttccagagacatgtatgatagggaagggaccccagaatgcttcctgttgccagatcaacactttcaaactcctccttgccctcctctgaattcttctagcgtaactgccatagaaagcatgctaaatattattgctttgagacagaaaaacttggcatttaattttaacttcaccactctacttaatacctctgggtttaattttgccatatgaaaggccaatctagataagtggcacacgtttactgcattattgtaaaatttaaatgagataatattcataaaagccctccagcagttaatatgtgtattatttctttgcttagtatgacttgaaaatagtgaaatctgtacattttattaaaaacaacaagaaaaaattccctgctttcataacttgccagttttattgacttgctgtgtaactcatggttgaaacaatgcagatttatatttaaggtagaaattctcttttgctcatttcaacctaattacaccaaattttgccttccttcctttttcccccaccttaaccattctcctttttcccttgtggcaaaatctaatgattcctatctttaatcatgagcaattaagtcacagtggaatatctctttgcctctggaatgcatggtaacctcatactctgacttatgaaactggaaacgtaaattacagcataaaatatttatcaattaaaattgtgttaatttttttaaatccaggtaatttttaacaacttttattccaggaaattataagtctatatttgctatggtttctaccattaaatatatgtatacacatatgcatacatatatatatatactatatacatatataatatttaatataagtttaattttacaatgaacccaatgtaccaggttggtgctttttaatgagaaatatatgtaatagaatgtttaataaatccatgaaatattaaacctaacttagtacttgggaatcttaaatccctcattaattttaagaaaggatgataaatataaatatatatatatattttatatatatatatatataaaatgtgcttttagtgatgcattatttgagccttaatacatttaaaagaatggctagaccagtgagcctaaaggacgttaaagatctttcctattctggatagaacagaagtgaagctgatgcatttttcagtgtctgttatctaccagatactgtgctagtggcttcataatcttggtctcctctaatcttccagcaaccccattttaaaatgccaaaatagccacttaaggataaggacagcagcatctctcaaggctaacttcctctctcatacctagtaagtggaaaaacagaggcttgtatgatatttaaacatagcctatgcacttttctatttcctacactgcttttagttagaaaagaaaaaaaaatgatcacaaatcactggtaaacatctgcaacatagaataatgcttctattatccagaatttaattaaatacacagatactttttttagtaccaagttggtttatgttagagtgtaactaatatgctcttcatagaaatgcagaaagacaagtggttaaaactatttgtgtaaaacatgatattatagccttggaagtgagaatcaggtatgaagcaatccttcttaatgtagggcccagctttgcttggccactttagagatggagtgtttcagtccttgtccttgttttccatctgtctggtctttggaaagcagaacagatgtaaatggtagagttctgagccattcaattagatttcatgcaccactgacccaaacatttctcctcaatcttatctgagttggtggcagatgtgcagcatgtcagaaagcattttcaaattaaagatggaaacatattgtatgttggttgatatggtcacaatatgtgtaagtggtaaaatatgtcaccactagagcaacaactatgatgcaagaaggaacaggaaaaatgggcatttcacatttcctttccttattatcagaagacaagaaagtataatttgtcaaatgtgcattggaaatcatgggcttcctgatatgtaataaagaccaatgtaaggctaattggattggactctgcattctgccatttacagggcttaatcaaggcatcttggtaatagagctgagtctgtgatgatttatgtagatagggctttgccatcactgaagatgatgagacttacactcagggaccctcatcattacccattcactcagcctcacaatccatggctgactcaaatcatgttgtgaatcagctaattaacaatgagatccttgcacttttatagatgatcaattaatacttgtcaatttattaagtttgcttgatgggctttagcaggtttcttgttgaggttatgagaacaatgatggcatagaagagagaaagaagcaaatatatatgtagataacctaccggctgtatggaccctgggcttaatggagatctcagtacaccctggggaaaggtgaggcccaataaaggcttccatactgaccatgaagagtgttttgaacctgatccaggatctgaagttctgaaatcacccacatattgtgtcattatcaatgagagtatacaaagaacagtcaaaaggaaataaacccatgcacaggtgttacctaaaggatttcttctcttgggggtaagtgtgaattcacttgagtagagagcattacctttaaaaattatagattaaaagaattacaagggatattacaactaattttttcttctttccattgagtgtttgggacccatttccacaccctgcaacatacacacagaataacttttaggtccatttattcccaaaatattgaatttgatgtcctctaattcctgactcatgacagtcaagagcagaggcccgtacaaaccaatttcttggtacctctcttcttcctggttctgccaatactgagtttcctctatcagactcacagttgacctgttaacataggtcatgctagtttcctgtaatattttcctcctgctcaaatctggtactttccacacatttatttttctattatcagctaccttgagaaagacaggagatcatatatttagctatttagctatttttttttttaccatattgatgttcattgtagtttaaataactctacagtggttgcattttaataaggctgctcctgacaacagtcctgaccgattttggaaagataccaaaaataaaaataaggatctccagaagtcctgtggactctgtcgttggagctggagtgtgcctccatccgtagacttcctgccatggtttccttccagcacattttcttcagggcatggaggctgaaaatgcctgacttctccatttaaatcactttaagcaaaacacagattatttaagcatatcttttgcatcctccatgcccagtagtaattttgcaaaattactgggaatctatttcagggcaaacttggcatttaaattaggtggttttaattagcatcttgactgcatgcagtcaacagcatgaagagaaggacagggaaaaatcacatcagcttatatttttgctgtagaaaaaaataaataaaacaataatatgctgaaaaaataacctcaaataattcaaagcaagatggctggcaattttctggaattagaatgataaactttatcatatattgaaattgttatatactgcaagactccttttaattatctttaccagaattttcataaagtttacctttcttctacacaaagaggcccacagacagtgccattgcagttattctaacacaggtgccaaatggactctcacatacatcccttccccctccactgttaaatattacccatcattcaagccatgacttaaaaactcacttctaggttatataaaggtaaccttagccacaaatgtcatctctctgtagcttgagaactcccacaatattctcatacagtcatatggcaaaacaagaacaccaacaccattcattgtttaccagttctaggcagtacaatctcagtgcttttccggaattgcctcatttaaccttcacagcagccagatgaggtgtgtgctactatagtgtcccattttacaggtaaggaaacaaagacgctttacaaagtgtaagtgtcttgcccaaggtcacagctagtaaatgggagaattgggtttgaactcacagtctttgcaccacacactacattatattgtgaggtggagagagtctctcaatatcatggaatatgttttacatattttcatgtgatttgaattttaaagatagtgattggaagtgaactatgaataatttcattttatatatattttagttatcaaaacattgccgttaggctttttctgcagtaaatgattacattacaaagctgttcaggagacgttatttttttaatcattctctagcatatttttccttttgtccttttatactggtaagaacatccagattctcagatgggcttagctgcagccgtggagtataaacaggatggaaaaatagggtgttaaccattatttgagttggctctcaccatcccatggaactagaagcaatttagaaacaggtggccacagagtttgctcaagaaagtcctgccaaaccaagatagggactttactgacttcttcttactctgctgatgccactgtacagagctcagatgaaccttggttgttgactttactgcaagaaaaaaaaaagcggttccacatacacactctttcaacagcttgttgaattccaggcacactctgggaagcccttagaagtgatgacctcatgcagagaggaggctggaagctctgtcatttcaggaacagttacggaagtaggagtgcaattgaaactttggggactttatttaccactgtattcaatgacttcaacagcttcaatatggaaggaggatttaatttcttttgtgcaggataaacaagagaaagatctggctcaatattaagaagaatataaaatggtcacagagtgtattggaaaaagcacagaaatttattcagaacacttgattctgaactgagaccctggtcttgctgctgtcttcccataaggtttttctgcttagactttctgaaattcatttattcaaatgttaagtgagcatagtaatatctatcttttagatttggggaggataaaactactgaaagataaatcagttagcatgcatactaacattagggaggagcattcaagggatcagtacaggctgtgcaaccttttcccagtattgtcaaatgggaattcaaaaatccaataaacctgtaaaattgcttccaaaacagggactatgaaaaatgaaaatgtctaccattctccctgaagtccattaagggattcaaatacctataatgacttaaataagtttctttagtccggatttaggaaattgaaggttgaagtacaaaaaaagaaaaagaaaataagtaatgtatgcattttagtattatcttctggaaacaatttcttaacctgtgtgaattgcacaatccttgaacatgtggataccattctggtcggtaagcaagatgcagagtgctgtaggtgtgtacattcttaaatgaaacatacaccagtgagaagaatatacaggagagacagaagtatttctatccatggtagaactttctaagcaagttacccccaaatgagcatcctcctgaagtagtgagtttcctgccatggatgtatatgcttgagttaaaaattccttgagcaacccctgggtagggaggttacacagagctttcacatacagatgagagaattgaagtaaacatggattttgaagttcctttctaccatgattccattatacttcaggactttaaaatggggactagttgggatagatctgtgaagttaaaactgaaggaaccttcagatagtcttgacaataaggacagaagtcagaataaaatgatttcctcaagaatacctttgcctcctaaagtcagccttttttctcctctttgtgtatgaagagaaagggagtgaaaagcagatgtcccaatgaagatgtgattttgtatcattctggggaactgacaccaaagggaatccagggacccatggaccaggagccaggattcaccttcttccccagcaataaaaggggtgggagctgccagcaactaaatcgcagtttccagccagggagtatggtggcaaccatgctgcctaatacaaacaatgggtttgttccagtgcacacctcaagaaatgtatttaaattccaaatcccaaatgaattcggaataagaagaaaatgggaggcgccaaagagtaaaaagtcagagaaaagtaaataaagaggtaattttagagaagaacagcaatatgaaaatcttttcaagatagggttgtgtaaccaagcatttgtggacagggtgaggcaagatatatatggttttctttttttttttttttttcagataaaaatagcagtaactaattaagaaatcctggatcataaggaaaagtagaaagaagataagtcagttctagtcctagcacctaaacagagctactgtttatctttagataattcctttccaccagttattttcagtgtaagaattttaagttggcccggacgtggtggtgggcatctgtaatcccagctacttgggaggctgaggcaggagagtcacttgaacctgggaggcgaaggttgcagtgagctgagatcacgccactgcattccagcctggttgacaagagtgaaactctgtcaaaaaaaaaaaattaagttgaaatagttttaatggccaattttatatttaattttcatatgaatctagactatttctcttggttattataaacccttcaaaaatacaatttaatggctatgtaatattccttaaatagatacacattaacttattctatcttctgattgttggacaacaaggtttgctttcattgtttttactattcaaaagaggttttaattacatttttgttcacaaagactttttttctttaaattatactgctagcctgggattattgagtgtgaatataattaaagttttaatatacaatgttgcaataagttttccaagtgtcttcagatgagcaaaaacagtgtatgccttttatcacttctctgaggcagggttttggttgttactgtaaccttcttttcaggatgaggtctgggaattagtcattactctgtctgctgagaaaaagaacctatagcactttacagaaagctgctaattaatccttccaactctctagtgtgggaaggaggtagaaatgtctccactgcagtatttactaagaaatattgtaaatggatatgacagacaccaattcaaattccccggatgagggagagccgtcttgctagatgatcatgacttctgctaaaaacaacccccattgactccagaggtttcctagaagattctgggctgctgcatttgccatgcccatcgtctctatattttgaactcatgagaacccttgggtctagttcgggattccaccctcttccgaagagatacatacagtctgaaagtaatgataaaatttactaagtctttcaggcaatgtttaaaatttgtgcctacagtttccttcagcttttgtttccatttgactgtgggcatccccagatgccttcagccgtggttttttttttttttttcagtctttgtaatagctaacgctgacctccacgttggcactgaatttccttttttgatctcatgttctcataaggcaagatagccccatgcagcctctgatagggttcacgtgtctttgttagttttgtttttgtgatttttgtttgcttgcttttttatttgcaagtaattccacactgaaaatttaaaaataaaatttaaaaataacacccatggccaggtgtggtggctcacacctgtcatcccagcactttaagaggccgaggcaggcagatcacctgaggtcaggagttcaagaccagcccggccaacatggtgaaattccgtctctaccaaaaatacaaaaattagctgagtgtggtgccaggtgcctgtaatctcagctacttgggaggctgaggcagaagaatcacttgaacccgggagacagaggttgcactgggccgagatcacgccattgcacctccaacctgggcaacaagagcaaaaccctgtctcaaaaattaaaaaataaaaatgtaaaaaataacacccacatatccttttcccagactcagctattgataacattctaacccatttacttcatcattttccatctaccaagcgactgttcaatagctaacatttttttctgatccataaatggcctttgggcatatcgtatactctgggctactatttcatagacttgaagatatattctgcctgcatttagttacataagacatccaaatgctttctcccaggcccctgatattacttaaaggagtcagattttatagctctatgagctcccctttacctggagtgcttctttttatttctagccctttttttaattacactttcagctactgcaaatacttactcatgtttcaaggatcagctcaaatattcaattttagggactttctatgaacttttccctggcagaaatttcctttattacaactcattatcgtatttcattttctcctgtgtgtttttttctggtagttggtaatcttcgcaaaagagaaggactgtgtagtattatataattttccttggtatctagcaattagtttagtaaatgccatgttttaggtaccccaaaatacttgtgaatcatagtaatataaatcgtctgtctttgttcatttacgttattattaattattttgtttaatcttttagtttgcttttcctcttgatgattgacttggttcatttaataccccattaactcagctcttactctaagcaagctgctgtgatagttgctcaagtgggaagttacaacagttaagaatgcttttggctgcaacacaagaaaatctatagttaaggtatctggatataggtgatttagtctttgatgcagtggctcattgatatcatcaagttctcaggcttgtttgaccttttcactctgccattgacaggtttgttaactcatggtcacaggatagctactgtacctccaagcatcacattttcatctgactgtgtttaagcaagaaatgaagaggtctgggtaaatggagatttctttaaattggatgaaaattgttttccagaaatcgtccagaagacttttccttatagtgcatttgctagaactgggtcacatatatatgcttagtggcaagaggtgttgggaaagtaagtacctggcataggaaaatagaatttccaagactgttttaaaataatcattaatcatatctggattgggtccatcatcatcataaacaaagccaggtttctctgagcaaagaaggggagactaagttcttggatagaaatgtcaagttgtacgacacagtcacaaatcaatagatcatttcagaactcaatccaaaactcatatgttccaatagagttgggagggtgaaaaagcggacaagtgtaacgccattaatcatgatctggagggtgagaagagaggagacagatgccccagatagatataattagtattagtgcagtccaccaagggcttaaagtgtggcccaggagtcaagatgtccaagcatcaggagtgtgtcagcaggctgatgtttacaaaggttaggactttctaccagcttatttaaagtctgttccagcgagctctgtttccacgagacgttactagaaaaatggaggctgtagccaagtttgggagatgggctatttgacattaatgtaccaaaatgtacacattttaagcagaggttgtagtggtcagtgtttctgaagcttatttgaccatcaatttttttgtccacagaaaagccaaatacatttggtaagtgttgtgtgtccttaacagcgaaaagagaactggcaagaaaaaggtgaaaggccaatcagagaaaaagaacctgaattttcaggcagatttttaagaaagatattaaaacattgataaccaaagttcagtgatcagaacttgggcatatagagattatggttcataaaggacaacgggcccatgagatattagcagcatgggcctttgttgttggatcatctgaacactggactagaagaagtgttcaggtgaatcctctaaattgtagaagcaattttccaagaatgagccatgttcaaggtaaaagtggagttatttttttgaggggagggagcagtgcaatgcacagggtgtccagtcatgactggaagatcaattaaaagcagaatcatggagagtagaaaagggtgaagaagacacaaggcaaggcttgataatgtacatgtacacatgtgtttatgtatacagtacacagaagtatgtatgtatgcttgtattacacacacagaaagaaatcactagagtcccatattcattatttatgttgtgatcttcagaagtttagaggtaattaaaaatagcatgtctagtttcacaataatttgggagatgcacattttttaaaaactcaaattaaataagtttgttcaatatttttagagatctcatgaaatagacccagaagagagccaatgctttcctctctaatatgtaaacatatcttatttagagaaatatagttagaaagtctggcagaaatcagtccaatggtttttcctgaaagcaaagtcaactattgatacctagaaagttctttggggaaagtgtaaggaaccagtaagtgattaaagtacatatttgacacatgttattcaccacatcattaattactcacttttcctccatatgcaggtcagatgatggttggatagagtgttggattttataatgttacattgttataaattgtaggggtagaagacaagagaagccatcaggtgcacctttctataaatgtgggttgggatgaggaaaaaggaagacagttgtgaccaggttcattgggccttgagagagtgatggtatatgggttagcttgaactaatctagaaccttcttcttaacaattaacagaactagaaagaatacttatatcttttggatttataaaggcgatcataaaataacttaaaaatacttgaagaaaagacctgaacccaaatggcttcatatcaaactacaagcaattcttggttaggagaggctaatacagtgcatcaaacctaaaccactctgcagtcttttactaccaccttcgtttgatcttctttcatcttctttgtcccatgatttctattctatctcattctgcaggcatcagaacccacgtagttatttgaaaggttctctccccataatctaaagactccagcttgactaaagttctaaagctccaaagaccccaaattcaagagcttttatgcttctttagcttcttttcttatttttggattctgtaagaatacatgcccatgatggagttgctgggcaggctttccagtccccaagaagggacatattcctgtcttctgagggtgctgtaggtcttctgttgggctgggggaggattcatggtcttacttttggaggggaaaacgccccttcttatctgagctccattttttctcatagacaaaagggtttactgtcattattattattattgttatctgtcctcgacgtagcagaagctaaatacattttttggtttgaaacaacaggctagacatccatagtattacttgtagtgcaccaacataaacaataccaaactagaatgttctcttctcctttcccttttcttctcaaataatgcagtcctgaagacataatatgagacattgcaaaggctgtgttcaggatgattgttggtgctgggcagggaggctgcagtggactaggcttgggctttggagcccaagtgagaggaaaaagtaaaacgtttatgaagtaggaaggagattgcctggtgagtggtgtcagagttgaagtgggtatgggggtgtccatatgtagagtggcttcgtgcgtagtgtcaaagtccaagggaatcttcatggggaaaggagtagtagcaacaatggaagattggttatatgtagtaatattaatccataagtaaatatattaaaggcagtgagagccatgcttctctttggaggggaagaaaaattgcaaataagagaaagaaaactaggatgaacctttttgtatgagactggaattatagccattaatctgaactcatggttttcaatatgtgtgtctatctacatatgtgtgtgtgtgtgtgtctgtgtgtgtgtgtgtgtgtaaatatgtgtacaggcatgcggtgtgtgtgcattccttagttctgtcaggtgagagagcctgggattaatgacactccacatcttggcatctaaataccattcttctccaaaagaaaccagtttgtcctggagaaacattagtttgcaagaaaagtacaagacaagccaagcctggaatgtctttttgtaccagaaagcaaaggagttctcaaaaagaatgatgagatgttcacatataagtgagaccatataatatttttctttctgtatctggtttatttcacttagcataatgtactccagggttatccatgttgcagcaaatggcaggatttcctactatttaaaggctgaataatattcagtttctttatctatttgtcctccatggacactcaggttatttccatatcttggctattctaaataatgttgcaatgaacatgggcatggagatatctttatgaggtggtgattttattttctttgagtatatacccagaagaggaattgctgggtcatatggtaactctgtttttaatctcttgtgggctgtgtgtgtgtgtgtgtgtgagagagagagtgtgtgtgagagagtgtgtgtgtgtttgagatagagaataaaatagtggctaccagaggcaggattaagggtaggaaatggggagatgtaggtcaaaagatactaagtagcagatatgtaggatgaacaaatttaaagatacaaagtacaacatgaagactatagttaattatagtgtattgtattcaggatttttgctaaatgactagattgtaactgctcctgccacagaggaaaaatagataactatgtgagacgatttgtttcatgatagtaactgttatactgtatatgtgtagctgaaaacagcatatattatgccttaagtatacacaataaaatttatttttttaaatgatgagaatatattaaaaggacacataagcctttttaaacggctcctactggccaaatttgggatgaattgagaattataataaataatgttagtaattgattatagctgattaaatgacatagaaaaaagaatttgttctgatataaataaaccaatgaataagataaatatttgttgaggaacaggatatttacatggtctcaccttgtcacaaaatacttattaattacaacaggaaacagtgaatctacattgaagaggccagtcataccccatttgaatccagtaatcagtatgaacatcattaatgatgagtcaagtcccataggatataatcagaagaatgagacatcacatcaataatgtgtaacctgtatctaattatgagggaacatcaggaaaaccaaaattgatagattgtccacaaaacaactgtcttgtagtcttcaaaaaatgtcaaagtcatgaaagtcaaggaaagactgaagaaatgtctcaaactgaagaaaataaatacaatatgacagctaagtacaatgcttacttgtgatccagagctttttgtcacaaaggccattattggaacaactggtgaaatttgaatagaatctgaaaattagatgatagccctgtggtaaagttaatttcccagagcattcgatgatagcaatgcggtaaagttaatttcccaattttgatatttatatcacagtcatgtataaaaaaatgtcctcatttgtgagaaatacacactagagtacttaagagtagtggagaatcaatttggcaatttacactaaaaaatttgcaggaaaaaacattcctttcactatattggaaactttcctgtaagtttagagttagtgacttcttgacaaacacctgaaatctgagctttaaaactgtaaaatgaaactataagaaaagaggaaaaaagatacgatgctgaattaaacatatgtatcacatacaagtgccactcttggatgaaatgctcttggtacagagcctgctggtaggttaataggaggaacataccgatttccatgccatgttcaaaggtgaatttgatcattctatgcaaattatatctgtactggagacttgtaattagtctaagcataatatgattaggtggatgaaatattttggagtttggttttgttttaaatgtaaatactcatgaaaagtaaaacatactgcactgtgtccctgggaatatttttgttatctttaaaatactcagtattataggcatttattaacacagccttacatttgcccggtttgacctggaggccgaaatgaattgtgacttatgtcccagctggtgttcccaaattatggcaaggactggatgtcatttgttgctgtgaatgacttcttgccagaaacctgagatctaagcatccaaaatcacactccaagggattcctgaaatacactttttttttttttcttttgagacggagtcttgctctgtcaccaggctggagtgcagtggtgcgatctcagctaactgcagcttccacctcgcaggttcaagtgattctcctgccttagcctcccaagtagctgggactacaggcacgtgccaccatgcccagctaatttgtgtatttttagtagcgacagggtttcaccatgttggccaggatggtctcaatctcttgacctcgggatcctcccgcctcagcctcccaaagtgctgggattacaagtgtgagccactgtgcccggccacatatttttttttaatcttctatcatataatcattaggtcgttgagcctttcaaaatcttctgtttgaaaacatccccttcaactctgtcgttgccatgtgaaaagatcaaattgaataatctactacccagtgtctctttatgtatgaaggctttaagccaaacacaggataccattgtcttaatcttcctgctgtataacaaaattacttaaactgggtaattaataaacaatagaagttttttgctcacagttgtggaggttggaaagttcaagtgtctagtgagatctctgtgctgcatagatggtgacttcttgctgtgtccacacatagtggaaagggtaaacaggctcccttgggcctcttttataaggctactaatcatatttatgaaagcagagctttcatgacctaatcacttcccaaggctccaccttttaataccaccacctggggatttaggtttgaacatatgaattttggagagacacagacattcagaccatagcagctatttacccatgcaaataacaaatccagtgatcaagaagctagtcatcaccacagttggtcagttgcaaccactgaataaagacaatgggatatttagctggaaagatgttcagatgacatttcttttctaattttcattgaaatttttcaaagctgctagaagttagacttttttaaaaacactcccattaaaaaccagagaagctatgctcttgtttatattggaatcaaaccaaatttaacccccttttaagattttcttggctgtaagaatttcttggtaatggctgaaagagccctgattatttttttaatttgacttttatttaagttcaggggtacatatgaaggtttgttatataggtaaacttgtgtcatggggtttgttttacagattatttcatcacccaggtattaagcctatacccattaattgttttcccgatcctctccctcctcccaccctccaccctccaataggccccagtgtgtgttgttcccctctatgtgtccatgtgttctcatcatttagctcccacttataagtgacaacatgcagtatttagttttctgttcccgtgttagtttgctagggataatggcctccagttccatccgtgttcctgcagaggacaagattgtattctttttgatggatgcatagcaaataccatttgacacagcaataccattactgggtatatacccaaagaaatgtaaattgttccattataaagatacatgcatgtgtatattcattgcagcactattcacaatagcaaagacatagcatcaacccaaatgtttgatcagtggtagacttgataaataaaatgtggtacatatacaccatggaatactatggagccctggtgattttatccagttgatgatacacttgggattactaaagcatagccatagccagttaggccacttcgtgttattcataaggaataagtcaaactttggactgcctggtaacatttcttcatattaagtcctaccttattctgagtgcaaatccatcatcaggtagtacctgttttctccatggactggacagggtgcatttataagcccatctttgtgtttagactgtactattaagaggaatatagcaaggacacctcttctccatttcacatgaagatggatgtattaagtattaactaggtgtttgcaaaatactttcaaggaaaaaaatgcaataaaagtgctaaatataattattattaaaaaattatgacaatcatttagatgagtaattttaaagctcttcattaaacatgattggatattatgttaattcattaagctctacttcaagtggtagataaataaggtgcattattaatatgtcataaactaaatgaaataatgcctcataggcctattatttttaaagtgccttgcaaatattaacaaatgcttacattcttttgaggacaacttgtacgatttgataggaattgttgcagtaattttgtttctcataatataaaatgcttactacaaaacctagggtctttaaatttttcagtctgtcgttttttttttttttttttttttttttttttttttttttgagacggagtctcgctctgtcgcccaggctggagtgcagtggcgcaatctcggctcactgcaagctccgcctcccgggttcacgccattctcctgcctcagcagtctgtcgttttttaagtaatgtatacttatttaaaaatacagatacatataaatatgaaaataaaattgttgctaatcactaaactacccaaataaagtctttgtgaatattttagaaacttttttgtcagttttctaagcttatatttgtgatctgtgcgcttgtgtatgtctgtatttctttcacaaagtgtcttattgtatataatgtctcatatattccatttctagttaaaatattaaacagaccacccttcccacactatttatgggcttgcaatgctattttttcactaaaaacaagtaaagaaacaagcaagtaaagaaacaaaaaagcagggtttcttagacaaatggctaatcctaggtctggtgtataagatgagcctgaaacattttcataacagatagtaagaaaagtagggcccatcaagagtactcatgatccaacctggagcccaggcactcacagcatcagaagccaactggctgaatgttggacaattcaggcaataacatcaatggattgaaatacatcaaatatgttaaaaatccatgccttcaaaataatacaaaagtaaaaaaataactgtttaccaatgcaggatgcttgtaaatcaacttatgattaaaacaacaaactaataaatagaaggaaagaagaaggttttatcctgttttaaattgtctttatttgtattaaatgtatgtggtaagtgtaattttgttacatggatagatcatgtagtggcaaagtcaaggcttttagggtattcatcatccaaattaatgtacactaagaaacttcttatcatccatcccctcaacctccccctttccaagtccctattgtttattattccacatgtgagcatgttatttaccgcccactaaatatctatgtccacgtgtgcatattttctagctcccacttgtgagaacatgcggtactttctgtctctgagctgtttcacttaagataatggcctacagttccatccatgttgctgcaaaagacatgattttatctatttgcatggcttcatggtattctattatatacatatgccacattttatctcctctatcaacaagtaaccaaatagtagatggagtttttttttttaatagaagtatattacagctggcaagtgagaaagaactgtcagaattagtataccacaattttccaactctaaattaattaatagaccaagacattgattattaacagctgttaacatcaataaaacagagtacaactaaatagcatatacttcctggtgaaataatgcacaccactcatgaactagtattgtttaaaaaatatgaacctagttctggtcaaacttctagatccaactactaatttatagaaaatcagatgatggagaaatatatgagatgataccatggttgaaactagcaaaaataagattgtagggaactctacaaggagaaaaaaaaaaccctggttcttccaatatacatacatactgaagagaaagagataacaagaaggaaacctacagggtaaaagaaacttaaataaaaatatcaaacaattgtgaaatgtgaatcttatttatattttaatttaaacaaaaagctgctgaaagatatcgtcaacatttgtgaaacatttagatatgtgaacactgaatatttgattattttgaaaaacattgttcacctttaggtgaaataatagtgtgtttatgtgtctatgtgtattatacatacacatatatatatatatttaaaaggatatttgtcttatagaaatagatcctgaaaaatgtgtatggataaagtgatatgaatttcctttaaaataattttagggcggaaggtagccacaagataaccatttattatactcttctgcctacctttacatatttttgaaatttaataataaaatattttaaaatatactgacttttctttcttataacaaagttttctttgaagacatgtgatatggtttggctctgtgtccccatccaaatctcatcttgtagctcccataattcccacatgttgccagagggacccagtgaaagataattgaatcatggtcagggccaggggggtggtttcctgtgctgttattgtgatagtgaataagtctaatgagatctgatggttttaaaaaggagagtttccctgcagaagctctctctctctttgcctgccaccatccatttaagatgtgacttgctcctccctgccttccactatgattgtgaggcctccccagccatatggaactgtaagtccattaaacttctttcttttctaaattgcccaggctcgggtatgtatttatcagcagtgtgaaaactgactgataccacatgattgccaaggtttccctaagcatgattaataatatattattgcttattaaatagatcagagggtctaaaacctacaaactgtgaggccttgaaagaaacttgatctagaatttttgtattccaattttattatatttgtctccaaaatttatctgtttttcttacactgattattaaatagtctaatcttttcccattattgtgaaatgaccctgttgcttcattcaagtacactgtgtatgcttcagttctctggcatgtccctgggctaatcctgggttctacttattcgttatttgtctcactgcttttcagctcctccgtttcttttgaatttctctctctctttctctgtctctgacacacacgcgcacacacacacacacacccacacacacacacacacacgagaatttcccaaatgtttgatccttgactaaccatttttatttaaaagcagtaaaaaagcagattggaaaccctggatataggggttaattgagttatagcagcagtgataagtccttttgctttggctggtctgtttctacagcaataaatcttccaatcttctgccttgtctgccagctttctagaagttaacagaagagcttttcttgagggtggggatataggaacctaatgctccttatataaacttcaagacacctgtgttttcagctcaccccactttcagaggtacctgattccttcaatccctgattctttccagcagtcacatgcaggaatgggatgcttcctgttggttttcctctctatctgcataggtgatgataagtttctaaagtgtttgcttcctaaatgagttgtgactataaagaaactttctagcttccaaaccactggtgatatctatgcttattttcttttattcttgagggcagatgccttttctcttctttttttaactgttaaatgaggttttgagctgttagagataagttccaaaaataactaaaatcataactctcaaaatgttaaagattttatttaacttactaatgaggaaactagtgagacattacaaccagttcaaagaagaatccaaggaacagatgcatttataattagcaatatttaaatgaatgtgcaaatagaggcaaaatttgttttttcttcagtaggagagcaaaatcaattaaaactctaccagacaggacagaatgtgtgtgtctatggacggggatgattttgcattgcttttagttattggcaatttacagagttgtaaaataactcccccagaattggaatcatcagatatcacagaaaagtatgctaagacattgcccagttttccactgaaacacatttttcccctacatggctcaaacaggatgaagccatgggttcaactattgaagtttaagtgagtgtatccatacctaattttcctttctttcttttttcttaggtgaactctactagacgatgaagtaatgcctgcatgtttttctgtcaatacaaaataatcaataatttgctttacagttttgagaaaacccattgatgctatgacaaaggttgcctgccttttccattttgctgctgttttcatattttttcttttttcttctaaacatcttaatgagtcagaagtatcatgatagaaaactgttaagctggtattatatgataccagatacccttgaaaatatctcatctatgcagtttcaccaacatttacacaagacttgaaaagcacccaaggtctgtcatagccagagaatattttctcctccagcactttctgtaaggtgtgagatcatttgatttgtgcatgagatcaaaataccagatcaagtgcatcagtgaatttctaattcttggaatgccttgtgacagtcactgtcttggcctaatcagaattgttatttactttagaattgccccacccatatggtcctctcaacagttcctggtgtccacagcccaggctgctgtcagtgttccagttccttgttgcattcataattgctccaaagtcattcttcaatgtgcaaactctttctgcctcaaccattatcagttgaacaagtatatttctatggtttgtgctgtttctgttcctgaatgcaactgcccaaatccatggcaaaataagacctttaggatataagaatatgaactcttcttgaatactactgcttttcatgtcttcttcttacgtcttccactaagtctgcagtaagagacttgcagcccctatggttataggtggggaaaaaacaagagtgttgtattgagacctgccttcaggcctctttcatttttccaaatccctttcttctatgttttctttttttaatttttattttttttcctatcttattgagcaacttctcttctctcagctatagtgcctggagataaaagctgtcatattgcagcttaaatacagtttcaacatatttcagtagcagctatacaatttctatagagtcagggattaacgtcagcagtttggttggaaaaaggcagggagaatattgaaaccatgttcatatgacacttgacatagaattgaggaaataacaattttccatgacaaagaatgagaaggaacaagtatgtattattggggatctgaatgcttgatccttgctacctcctaacctcttggccctacagctgactctattatgccctttgagaaacatcgtaaacaaaagtagtgggggtggggttttacagaggcaggcagatgagggagtaatccacaagtttatgggagtaatgaggtaagatggagatggaacttatcttgaaatatgtgagagcagagtgatcatttgcactcagccatttcttaattcttagaacgcaaaaggatggggagacttctcaaccttcactgtgttccaacttctaggaatttaggactcatgtaaagtacaatatggtcacctgtcacgtgtggtttgcattcctgttctttctgcaagtacatcatagcatgtcccccagtttttcaagtatatgacaaatgtgatttaacttcccattacagtaaattacgatgtcgaagacaaacaaagctagatgttggttaaagacgtccagcagttggttaagacagattttattcatataataactattacaatagggaagagagtctattgtaaactgagctcaactttgccagagcaagagacagaagtgttcttagatgctggggtatgctcaaggaaaggcactgattggtgttaagcatggtgggggagcagagatcagaccatgtgattgggccgtcagggtttgctaactggtgcttatccagaggagaaacaaatttctcctatctttctgtcagaaggtagtaagttggaacaaggtgcccaccaaatttaggcctttatcttcccacagggactgagagagaaagagataactttttaaacttttgcatttcttttttttttttttgctgttacttcacctttatttttttatgttctcttttttaattttattattattatactttaagttttagggtacatgtgcacaatgtgcaggttagttacatatgtatacatgtgccatgctggtgtgctgcacccattaactcttcatttagcattagatatatctcctaatgctatccctccccactcccccgaccccacaacagtccccagagtgtgatgttccccttcctgtgtccatgtgttctcattgttcaattcccacctatgagtgagaatatgcggtgtttggttttttgttcttgcgatagtttactgaggatgatgatttccagtttcatccttgtccctacaaaggacatgaactcatccttttttatggctgcatagtattccatggtgtatatgtgccacattttcttaatccagtctatcattgttggacatttggtttggttccaagtctttgctattgtgaatagagctgcaataaacatacgtgtgcatgtgtctttatagcagcatgatttatagtcctttgggtatatatccagtaatgggatggctgggccaaatggtatttctagttctagatccctgaggaatcaccacactgacttccacaatggttgaactagtttacagtcccaccaacagtgtaaaagtgttcctatttctccacatcctctccagcacctgttgtttcctgaatttttaatgattgccattctaactggtgtgagatggtatctcattgtggttttgatttgcattttttgatggccagtgatggtgagcattttttcatgtgttttttggctgcataattgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtactgcctaggttttcttctagggtttttatggttttaggtctaacgtttaagtctttaatccatcttgaattcatttttgtgtaaggtgtaagaaagggatccagtttcagctttctacatatggctagccagttttcccagcaccatttattaaatagggaatcgtttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgccctccagctttgttcttttggcttaggattaacttggtgttgcgggctcttttttggttctgtatgaactttaaagtgtttttttccaattctgtgaagaaagtcattggtagcttgatggggatggcattgaagctataaattaccttgggcagtatggccattttcacgatattgattcttcctgcccatgagcatggaatgttcttccatttgtttgtatcctcttctatttcattgagcagtggtttgtagttctccttgaagaggtccttcacgtcccttgtaagttggattcctaggtattttattctctttgaagcaattgtgaatgggagttcactcatgatttggctctctgtttgtctgttactggtgtatgagaatgcttgtgatttttgtacattgattttgtaccctgagactttgctgaagttgctgatcagcttaaggagattttgggctgagacaatgcaacaacccttcatgctaaaaactctcaataaattaggtattgatgggacatatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaattaggcaggtgaaggaaataaagggtattcaattaggaaaagaggaagtgaaattgtccctgtttgcagatgacatgattgtagatctagaaaatgtttgcatttcaaagagacacccctctacctcctgcctccccttcacagtccttgagaagacagtttggggtggcagaatatttacatataaacaggcagagaaaggatttataattgcaaactttctaaagtatctgctctaagaggagctttaggggcctataagcctatcacaagcttttgactggaacaaacagtaaattctcctggcagtattgtgctttctggtgcaggctttttttttttttttttttttttttttctgagacagagtcttgctctgtggcccaggctggagtgcagtggcactatctcagctcactgtaacctctgcctcccaggtttaagcgtccctagtaactgggattacaggcacacaccaccacgcccggctaatttttgtatttttaatagagacagagtttcaccatgttggccagactggtcttgaactcctgaccttaggtgatctgcccacttcagcctcccaaagtgctgggattataggcatgagccactgcgcctggctggtgcaggcattttaatgagggtaggatgatctttgggacacagccttaaactgctagaagctatgctaaagttaagtctcttagtggtggaatttgggtggactgattattgctcagaattttttgtagttctcagtggaagttctttttttaaataacccactagtgaccttattgttgtaatggtggacattggcagtgaaagactatctttgtaccagattacaaccctgtaagcttctcaaacactcagaaaaatccaagaattctcaagaaattgaccctgttcagtcaatcaagccagacaagcatggggccaggtggtactgtgagatttcttggagtccagtgaaaacctaaacaaccaaacaaacaaaagtaatgtgacctagttaccaaaatattacgcttcttctttgtcatgatatgtatatgtatgtgtatgtctccctttacaggccatgtagtatatttcccacccttaatattaatattttgtaattgttacagcaaccttaagaattttcctaggctgctattcattaaggaggatactggccctgggctatgcttgcagcttccagctcctcccagcgagctattaattctctaaaaatgttttggtacttaatatgctgcctcctaatttatagcatctcactaagaaggaaacaaaaacaaaaaaaaacacctaatgttgtttgacctctgctatatcagcatgagggacacatctgtgtctcaacagctaataaaaatagagtcacaagggtgatgggcaaattttggtgagtgatttttgttgttgattaccacagacactagaactaaaatttcagtaggttgctactgattgcatgtcatggaatgctgggccatgcatccacatcagtttaagtaacagtggttaactggttaagtcattttccagacacagaaaaagtttgaggtacatattttttcttggtaatccaaaagaacttccacatcatcacgtaattgtttatttgctatttttacagacatttaaaaaatggaaaaacagaaagattcagtagtcatttagcttttataaaagaagcagatgccagggccccacctacagagatctgacagagttggtctgtccacacagagcctagatttttacatttcatcaagtgattttgatatatttcaagcccacacattgggaaaaactgctttcagacacttaacacatttaaacagagaagctttagctcaagtttgcatacaaaaatctataagtgatggaagcatataattgggctgctggttgagaaaggcagaaagcaacaggaggccattgagataaagaggaaaaatggtaagaaaattaggccaactatttgtagtgcactcatttcattttcttgtttagtttacattggttagaagaagatgacatggactaagtgtaaggtgaggtagtgggagtcgagaacaggaagaccactttagggtggggaggtctagaataagaagctgagcttagaatgtgatgtctgtgtgaaaagaactttagagatctccagattaaaaagagatctccatatttcctaataaggggaaaagaaaagatatgtccaataaaagagaaataatggggacttctaacaaatattgatgaagtgaaggaatgagacttccaagactgggtcataaaggacaccacagctgttctttgctctctcaggtcattctgtctggggaaagccatctgccatgtcataaggacactcaagctgtcctgtggagaagcctacatgacaaggaactgaggactccttggcaatagccagtgacgagtttaggcctttagccagcagtcgtgagtgtgccattgtggaagcagagcctttggcccataattttcaaccaaaggtgattttatacccccatggacttgtcaatgtctagagacattttggttgtcacaactgggaggtgggggtaatactagcgtgtaatggttggaggccatggatgctggcctcatagatatatgaggtatatattcatccccaaatatcagtagttccaaggtaaagaaacctgctcagtcccagtcaagccttcagatgactgcatcccagttgacatttggactgcaacattgaggcaggatatttccctgacctcttcacgggactcacagagggagtgcctcatttactcaacccacagttcttgactccttgtgggaggaagcacacaagtgagtgaggcaggaactggagtgcagaggtgctagaactagccagctgctttggcaccagcaggggtgaacttcattcacttggacctgctgtgatctgcccctggtgggaggaagcatgcaggtgagttggtgcaggagccaggatgagcgcttttagggtgccagcaggagtgaactccattgtgggccctgcagcagcacctggagggggtgcctgcaacccatgaagccgcagaggcagctgccttccaccggtgagggcaaagggtcagtgtgacagcctttttgtatccacactcttggctcctgagcccttatctagcatctaggagaatggaggtcacacgaatgaattgaaggatggtaaatgagggggattttattgccaatgaaagtggctctcagcaggaaggggagctgaaaaggggacagacgagatgggaagataatcttcccctgaagactggccatctccagatggatttatctcagaagttaggccctcaaggtttccctctgaagtcaagctgcttctctcctctccccaattgtagcctccaacatctagctgcttctcttctctctgctggctgagcctggggtttttataggcagaggatgtcaggtagggcaggccatgggtggttttggaaaaggcaacattcaagcaggaaaacagggatgtcagttctcactttgagctagtctcaggtttttcggcttgagggtggggctttgacagggacccacccctgtctgcctagaatttctcttcctcctgtccccatcaatgtcatgagagattttgagccacagccactcagttcatctgctccaggatttctgacctttcaaatgtgtgtgagataataaatgtgttgttttaagctgctgagttttgggttatttatgcagcaataaataactaatacagcccccaaaatgtttctctagggttggagtagatattttaagtaaccaaatcaggctggtatttggagggcataagagggacagacagaacatgaataaatatttctgctaaatagcatgttgggcagtaaagtatattttattatcatagttcatgagacttaccaaagctcaattagtgatgattataacaagtggcttgttaaagctgaaacttacatgtttcatacctcttggcagaaagacactggtaactgtcaagatttccaggaataattaagagtgctgaatgaggcagcaaggccttatggaatcagtaagtaaagaaaaacagaagttgcatatttacaaactgaacagtgaagtgagtaggtgataaatagagaagctaccaggatagaagcaaggtatgttagagatgatgctgtcatctttgtaaactttagtggagggctcaaagaagagaagttgaggctgatgttctgcaaatgtgactgaatgcaaactccctggagagcctgtggaaatgcagattgaggggctgcagattctgcatttgactaacaagtcccaagagaaaatgaaagaacttgattctgtagagaggacatttcttcttgtaaggcctcagagatgaaagggaattatattgataagacacacatatttggaagatgagaaaagggatccattctcatacaactagttcaggtttttttttaaaaaaaaaaacaaaggtggtgggggtggatcaccataatcctgccaagagtgaaagtaataggaacagagggggaaagcagcagaggaagggcaatggtttggaatagctgcaaggaataaataaagtggcgatgagctgtgccataagagcgagggcctcatcaagttgggataaataggatttactgagctacagtacacaatcacaggaacaagaggactagaagcttcagcttttagaaatgccacacacatacacttctaggtggcaggggggtgcaaagccagagattacgtactactgcgggtgtcttttctttcaacgagactctgtggcagccaaaatttgtagctgaaaagtaagctgcacagagcagttagacaagagcactacattatttgtgcagttttttgggggcttgtgaaatggagctagaaataccattttttttcctggggttgcatgggatgcgaccgtaagtgaatacatcatggtgataggctggacatgacccctttccctcttaagtgaaggttgaaggagctatgttgaatgagaggatttaaaacacattttactattctcaagaattttatctctcattgcaggctttttggcaggtagttaagattccatgcaaatcattttaaaataaagagggttgtgtgctcactgactgtgtagtgttcagtcttctgaatatatcttggtgtcattttccaataaaatgagcaggaatataaaccttgggttaaaaataattcagaaatagcagttattctatccctacagcatgcaatgtgtaatctttgaaaacaaaattactcccagacacacagaaatgcttaatgtataaagcaaaaagctattattatatagtcatcttagatttcttctaaatgtgtgcacagcacaaataattaataagtgaatgaacattgttaaacatgcctgttcgaaagtctcatcattagttatttcattatatattaattgttttcctgtattgtataacttttttctgttgatatcaaggtaaataaaatatgattctttttccaaggatttcagaatctattaaagagacagctagggaaatttatacagcaatgtaataaatgatatgttaaagataaacattataggaaataattcttctccgtggaaagaaaccttccttggtggctgaatcttcaggtaacatagaagtttgccttttgatatatttttaaagtgttatacgtatctcccaccaaaaatatattattggtacaatttctgaagttttaaaaattataaacaattttatattgactctgaaagcaaattattgtctaaatcagtagtacacagtttattttactgagaaagttttatttgccttaactattatataaaatatattaaataaaatgggtttttcatttaaaatgatatactgtcttatttcttatatatcagaataaattccaaatggatcaaggattttcgtgttagaaatagtacagtgaaagtacacgaagacaaaataaaatgatttgtatactttcttaatgaaaaataaaggataaaattgtcacatttaaaaatattctacagtaaaaaatggcattaaaaaacaaaagaaaaaatgacaacctgtagtaaacatctttgcaacaaataagcattaattttctaaattcatagaaatatacttaaaactgaaaatcaaaggatcaataaaaacaataggatatttttaagtacatgaaacagattatgcaaacacacatgaaaaatgcacacttctttttttcgggtgtggaacattaacataattagacatgaattttccttcatccaattgacagttgttcacgggattggaagaatgtggagatacagataccctcctctactctgggaaagggagtaagatatccttaagacaaatttagtaaaaactgcaagaaattaatggagcaattttacttctacatatctatttatcctacatatctatttacatgtgttgatagcagtaatgctgattacagtattgtttgaaagaaaatctcaaaaacaatctaaaagctcatcactaagaactagatcaattatcatgtgtccataaaacagaatattatgtgactattagcaagcataatataaatctatatatactgctttggaattaattatatcaaagagatgtagatataggactaaacacacacaaacaagatgtcaggacatctttgtaaaattttctcattcattttaataaacacacatatgaccttgtattagtttgcactctgaaattactgatatttgacatttttaacctaaagaaaagggactctcatagagttccaactaatatctaaaagtagtttcttgaaggatagtcaggaaactgttaaaactgtttgcctctggggagagcatctaatgcagaaggcaggtgcaattttaagcttttaaacaagttcatgtattacttttcagctgaaaagggatttttttaattacacaagttaaaataaataactgcattggcaacagacaaaaaaattgagcaatatattgaaaaatctttacataatccctatcacttatattacaagaactttggtgatctcttacttttctttctttctttcttttttcttttttttttttttttggtagtaacctccacatgctggaatgcctcagagtacattttaatatgattgcatcaaataaataccaaatttgaaaatagaaaagcattaaaccaattacataggtgtccactttaggttttcttgaatgtcctgagaatggaaatcatatcaaacaaattgtagtgaaactttatagggtcattttctttacatatcctttccttttcctaaagaaccactcctgtttttccccttcccaaatctttagttctctagccctcatttcccattctcttttgctgcaatccacctgtctgaaccatttgcccaggtctaagcctctgtctttgcatctcagccctgcctggtacctgtccagcaagggactggaagctgctggtaagaaaggttgcttctccatcagcagtcatggaggagaaggcggatctaaaacattaagacatgccccctcttatctgtcacatcatgcctcatatatctattttataacaaccccctcaaaattggaaaataaaagatctctttaaaacttaagccaggtcatgatgtagggtctcaagatctgccctgcccccaccttgccaacctatgtggctctcttctctctcgtctctggctctcctcccctcatcacgctggcctccaagctctcattccaacatgccaggcaggcttccccacacacccgtatatctcaattcctacttcctcacctctttcaggttttaattcagttaccaccttcttggtaaaactaaccaagaccaaccttagaaaagcctttgatgcctaccttgaaatcctcatactttgctctttcactctctctggctctttattttttacatagcaccgatcacattctatataatatagcatttatttattttatgtatattgtttatcacctctctctctgttctgtctaggtcagctccatcaggtaaggggttttgttttgttttccattttgatgtcaagaatatatatcaatgtttgagatacagggagtgctagtcaagtaccttactttgagttgctgattttctttttcttctctcctgtttttacttattttttcttttttagatgtcaatattattttcaagtaattatgaatcagtttgtactttaatctgagatatcttgaagggataagtttattggtagcccatggtgatggctttgtgcaaattagaaaacaatgtcatttttgtaaagacaaagctgcaagttgtgtaacttgcagtgctaatcatgggctagtggttagactatattcaccctggggaaatacaggctaacacttgtgcaagaaaaaaggaaaaaaaaaactgtcacaactgtacattacaaatgaaggatgtaaaattactacattctataggcattgaaaagacaacaggaactattatgaaaaacgttatgtcaaagaatttgacaactttgatgaaatggacaaagaccttaaagatacaaactactagagttcgttcatgaaaaaatagataagataaataccctgatatttagaaaagaaattgaatatggtgttaagtagcttacacatacacagaaaaaaaaaaaaatccctctaagctcacatggttcacttttgaagtctgccaaacatttaaaagaaatgaaacaaaagaaaatctgattctacacaaactcttccaggatatttaaagaaggaaatattatctaactaattctaaggtcaagcattaccttgattccaaaaccagacaaagactttacaagaaaataaaaacataaaccaatattttccatgaacataaattcaaaagtccttaattatttagaaaattaaatccagccacactttatatagaaaagtatattgcatcataatcaaacaagtatttatcttagagacacaaaagtaaattaacatttgaaaattaatcattgtaattcagtatatgtactaactataataaaacatataaccatctcaaatgagaaaacttatttaacagaatccaacattcattcctgatagaaaaacaaaaaactcttgggaatgtaggaatggcagacaactttctcagtaaatggcatttatgaaaaatctacattaaatatactttttagttaaaattagaagtttgttccttaagatcaggattcagacaatatgttcatatttaccacttctattcagaattgtgaatctcaaaattattatgcaaagtaaaaaagccagaaaaaaaaaagagtatgtactaattgattccatttagagaaaacactaaaaaatacaaactaatctataatagaaaaccgattagtggttgccagggaaaggggactgtggaagtgggggcgggagagattaaataggaatagttagaaactttttgggtgaggcatactttcattattgtgattgaggttcatgatttcatggatgtatactcacattaaaatttattattttttgcattttaaatatgtgcagtttattttatgaattaaacctagataaaactgttaagggatacttttttcaatcatttttcacatgggaagtatatgttagctatgccattttgaaggggaagagaataaataggctttacagtttttatttttaaataaagctgggaaatgctaaatgggaatgaggaggctataattgttgactctttgacaatggaatttcaaacattaatggcttgttctagatagtacaaattcactgatttcattattctgagctcaagtaatctttgaaatctgggagtggatttattaccggagacataaggaaagaaatataataaacattgcaaatggaacaatcgtgaatcaaggttatattttagaattatcccaaacaatggcaagtgccttgtctagatattttcttccatcattaaaatatttcacagaaaatcatcaaaagcctggagaaatacttgtctggactttctacatgatagtcccggatgcaattatagtagtatagctgtctctgcaatttttttttaaacttttacacacattaaaatattctaggctgggcatggtggctcacgcctgtaattccagcactttgggaggatatttgataatttgaggtcaggagttcgaggccacatggtgaaaccccatctctattaaaaatacaaaaaattagctgggcatagtggggtggttgcctgtagtcctagctactcaggaggctgaggcaggagaataacttgaacatgggggtgaaggttgcagagagccaagatcgtgccactgcacttcagcctgggcaacagagcgagcgagcgagactccgtctccagcaaaacaaagcaaaacagaaaaccaaagaaaaatattctaaagaaaaaaaaaatcagttgttgttttaataggttcagaggtaagtttgccatatcttatttaccatgaatgactctagtaatggcaatgccatcaatgcctctcatcttccaatggttgccttttcttctgttattactggactgttgggactggtagcactggtcatataagatgcccacagttgctaaaggaggacactgttagaaataaagtgacggccgggtgcaatggctcatgtatgtaatcccaacactttgggaggttgaggcgggcaaatcgcctgaggtcaggagttcaagaccagcctggccaacatggtgaaatcccatctctactaaaaatacaaaaattatctgggcatggtggtggttgcctgtaatcccagctactccagaggctgaggcaagtgaatcacttgaacctgggaggcggaggttgcagtgagctgagaccgggacattgcactctagtgtgggcgacaagagcaaaactccctctcaaaaaaaaaaaaaaaaaaaaaaaaaaaaaaaaaaaaaaactggaaagaaaagaaataaagtgactactgcaatagataaaataaattgcccagctgcctccaggtttgctattttttcattatcagtgttttcttgacagtgttaaaacatttggccccctaaattcacagtttattggaacacttgatgaaagctgaatctctgtagtcatgctgttagtgactcactcttcctttgaaatgtctaatgcatagatttggtgaaatgctgttttcttaggaaagtttggtggacattaaaattgcttttgcaagtgaaattaaagacattaatgtaaagtggcagtgctaatagccagataattgcagtgttagaataaatttcagagtaattttgactaccaaccatctcttcacagctaaacttcagataaaaataaattttacatggaaccgtactgagatttctgctcaggatctttacccaattatctcttgcgttcctgttatttttttctaactgtttgagtttcatgtagagtgctctccattctttttctgtcaatttattaataatatattttgcttacggttcacttcttatcagtttaattttattttacttggacagagaatggtctgtagttttcttagtaagaaaactgaccaggctaagctatcgttgtttttttatgtcctccctcctttattttcaatgtcctccctcttccatttttagaacatatcctattttttctaagttatttatgtaagtcagatggatttactgttaatatgttaatctgtatatagtgaaaattaagaacctatttttcctaaatcatgcaggcatacattaattcctttgacaaatatttactgagcatttcctgtataccagatcatatgctaattgctgaaggttcttacttaaatatttactattccctcgtctgacaattactcactgggctcttactatatcctaggcattgtttcaggagctaggatacagtagttacagcaaaccaacacacaaactaactcaagtcctctctcatggagactgaattctattgaggaaaacagccttctccccagtccctgaatatacacccttactcacacatatatattttaatataatgtacacatataaatatataaacagcatattaaatatatagaatgtctattatatattgtaacaagtatatataagtaatattacatatgtgatattaaatacatacacaaatatgtatatatatatacagagaggcatatgttttaagtaattttattttacttacctccctattactgtgccatttcatagggctactaaaattattatgtgcctttctattattggtactctggtatatttgtgtgtgtgtgtgtgtttgtgtgtatgcgtgtgtgcgtgtgcacatgcacgcctgtgtgctgttgggcaggtgatcaatgatgataagtctgtagccagagctaagaccatgtgtgtggcgtatttatgtattcatgattataaaagtcccagtggtctgctgaggtggtctaggttggtctgctgaggttgggttgctatccaacacaaaacgcaagcactaatcaaatgtttgtttggataaagagcaagaacagatgctccaaatgaatacattaaacagagacccttgggtcattaaagcttcatgcctttgatctaacaaactcagatctacagacgcctcatcagtggtgaagctgtttcccatctgctgggggtggggacctagttctcatggagggttttgaggacaagcatctcttcctcccaatgccctgattataacaagccaggaaagagagcccaaagccaaatgcccctgccattgttggcgatattgatgtcacgtttgctgtacgtgaatagttcttcttctaaagtaatagattcatattgtttgctgtcctggctgtctcttttcttttctttcatatcttttgttgtgtttttaaagtgacttttatatatgaatacaaagcaactcacgaagtagggtgtgggttgggggcaagaagtgccctgcaggctttggactgtttgtccaccaggtataatcacactctgctttagaaaacttttaaagtcatcagcaaggctcaaacagactcttttaaaaaaaaaaaaatcatgaattctcatgagccaattcacagattgtatttataattaatagaaggtctggggtatcctatcctctaaaagatgcttagacacaaagagcagtccttgaaattatcaaggtatttgtctcaaaaccacacaggaaacaacttcagccctcagtaccagagacagacagtcaatcatagttcaaatagccacatggacaattcagaagagccaggctgaagctacagagcaagggaatggatatgtgccaagtgccagtgcccagctactgcactagcattttcacatgaactcccaggtttaaggccccctccacctctgggagggagcataacatttagatcctcttgacttgaccaaaaaagcttgggcagggtagaagtacatctctccctcaaataattagaacctgaggtaagagtcaacagcaggtataaaggctccataaaacctttgaggccacatggttcttttaactttataccttgtcctccctagcatgaggcttccatcctcaaggttacaagacagctactagagccccagccgatgtaactgtattccaggtaggaagaagaaaaagacaacatggggtaaaaagagcctttcttgaagcccatttcatgacttctatctgaaatctcttagatgattagatgtactcattgccattataaataaaaaaccatgttctcttaccaagaaaggagaataatatcggataggtaactagcagtctctgagcaaaaaggtataattattcccattgaaaactgagtctcaaagagataaatgaactgaaccaaggtcctcacagagtcagtcaatggcaactgacagttttcccagaggaacatctgttatggcatggaccacaggagtcacagcttgagtctaagcaggggctgaggttgtctgaattcatctgccattgaggtttcctgggatttaattgcataagtcaattagaattctaatttttgtatgagacaaacaaaagcaccagggtgtgcagagaatgtagatctgaaaaggactgtgaagggatgtgagggagagctataacctatctgggtatctttttttaacaatagcctcataagcacatatccaaacctaaggagttagcaaaggaggaaggagaattctaggatcaccaagccttagcatcaatcaacagggagtaaaaaagatggtattcactgacctttttgaaaacacagtgtgccctgagctcagcgagaacttcaataatgtcaatagctcatcaagtgtttgcagctttggggtgatgtgttcttgtcaagggaggacatgagcactgctgcaaacactagaaaatgatattagcacaaacactagaaatatcaggtttgtaagaagatacttgaggttacagccaaccttccacttgcttcaggttggccatcaataatgggtgcatttatagtaagccttcaattcccaaattatatctggagtttgaaaaaccaatggcaagaggcattgcctgattcaggaaacacatccaagccaactgacctgttaggtcactgaccacagttgaatgtaacgtttatgggaagcttggatcaacgaactgggcagccttattatgctgacccatggtatgtctactctttggggaggcttttcatgtggtgggagtaagaaagccccaggcttacagtttgatatttaatgtgttcaaatctgcttttctcttacacctttacccccatgcttctaaaaggaatttgtatgtccataatatatatcattacactgtggtgacaattgtactggggctgattcaaacttggagctaataaacaataaatagtttaaataatactgccatacaatttctgtcattactctctgcaccacctcctctcctccatgagtttcatcctgtccatcagttctctttagtactagctgattaaaaagtagatatcctgccaataaatctagtaagctgtgaaacatttgagacacacacttccgagactgttttcatcagtggtagattagtaacaatttgctaatgaagattttcttttaattattggggaaaaggcatttcttaattaataggaagattggtttcatccagattaattattgccgggaatgtgtcccaagcccactaggcacaagctatttaaagttatcatattagcaacaaagttaagcagcttggggtttagtcttaataatgcggaccatggtaattaagttgaggcttatggatggagggtcttcaggggggtccatgaactcataaaatttgatggaatatgtttcataactttctcagcttctcaatgaggcacatgatggccgagtatgagcaatagtctctggggtcgctgtcatccgtgttcccacagcatgcactcccaccgtccagctttcactccatgatggtccagtaactagtcattagtgaggccagaaatcagtgacaaaggaatcacagcctcgagttgaagagaccacaaagatcaccacaaccaggtctctcattctaatttttgtcactgaatgctgactaacaaagtgttagtatctcattttcttttcatcaatactctacagctcatgatccatattctccgccttctcacgatgatgtccattatttccctttttcagttttccatcatgatacatggaattcagctccatatttgatgaatatccttctattttcattcccagccattgttctgattgtttgctccatcccgttcctgaaacctgattgcaccttgttgaccttcttcagagaaggctgatttctatgtgccccttctgttcctcatgttctgaaagtaggtttgatatcctgctgattactcaagcccttcctatagcacgtacttcttcagttcttgaacaatagtgttattctttgagatacaacatatcacaattcatcctagcctgcttattatcatcaacaattttttgtagacaccatcttttattaaaatgttggtattatcccagttctacccatgaccttgacggtctcatctccagtaattttttcttccacttcatcatatccacccactttcatgatcacactttggatctaatcatcaactctgtactaattccattgctgtgctctcagaaaactttgtctcctcatgactggtttattcagtaatacctaccttgatcttttattaacctcataagcatctttagtcctttgatccctctttttttaataccataccagcaaccttaacattttcctttctttctttatcctgcttagattccttggcccatcaattcaggaacttcagtgcacctccacataacagagtgcgaagaacatttctgagtgcttatttcacatgaaatctcaacaatattttacccattgaacccaccctctctgtggtgacttttcttttccctgggcatccactctactagctttgctccaattatctggctactacttcattttttttctttcagacagtctcactctgttgcacaggatgagtacagtggcgcgatctcggctcactgcaacctacacctcccaggttcaagcgattctcctgcctcagccttcagagtagctgaggttacaggcatgtgccaccatgcccagctaatttttgtatttttagtagagacagggtttcgccaggctggtcaggctggtctcgatctcccgacctcaggtgatccacccgcctttgcctcccaatggctactacttctttacagatccatttgcaagctgagccttttcttctcagccatcagttgctggagagcctctgcttatgttctcaggcccccttcataaattactctgtattctctcccttggtgctattctttatcatctatgtgagcaagtcttcaaacctttattatagctcaaaattctccagagagatatagatgttcataactccttcccttgactgtcttaatggaaaattaaattcaacttgtccacaattaaaatgtcaattatcccatttaacctgattattttccaggtatgcttctcagagtgagaccctattcccatcaggttccatagtctgaaatcctcagccttccctctgacactactctttcccttatttgcatctaaaaaaaattgattttctgtctctcagatccatccatttcactttcatctccatttccaccaccatagcccaagttaccatttataattttctggacgaatgttgaataatttccattttgacattgccgtatggttaatcccttgaatcctcttcccaccatggctagagttctttacaaactgcagatctgacttctatcccaattctgaccctttatcctccactgttaaatccaatcatggcttcctgttgctcagtttgcttttccagaggtaatctgaaaatagaacactttattcttcgtattccagccatgtgtttattcatttttatacttggatatggtaataaatatttgtgagatgactttaataaatgcatgatacattatatatacagagtgtagtagggtacttgcacatcgtctagaaactttaatgcaacagtgattctacacaaacctcatttccatctttgggagtttgaacagcacctgatttaagttgaaagaagcagagttctgtgtttctgactggggtccacagcagagcgcccctgcctctacgtccattctcctcaccttgggttccaacactgacacaaaaatgagggactatagtcctctgaactcaggagtggtcaaaacataacctaaagcccaaaggtagctggaagagttgtgatatgattctcataaccaactcttctctaggtggcacacagagatttttgtcggtttactgaaacaggcaccaccctgaggcagtaccatggttctgagtgtaaacactgcccagatgtggctctttcatgcctcgggtgtgaggcagatgtgaagaatgatgtctccagcaccaggagcagggcttagcgatctgatgttaatgtgtttttttccagctgtgatttggatatctcaacagtggaataatttgcccaaagtacccgttgactctaagtagtctttagtgcggtgctcaaaaggctttacacagagatactgcctggaaggaaagctaatttttttttaactcacaggcctgagataatgacgaaaggagaggagaataaaattaaagagaggaagacttgagaggaggtgaaagtataccatctaccctggggcacccccagccaagtgatattaagtcttactccttgtcaagaatgtcagaatcctcttgtgtgtgtgctcccaacagttacttggaccttgggaagccagaattcaggaacatgagcagacttcatgattctgctagtaactctttgttcaccccaagaacagctctcaagagcccttctagcagtaacatctcagataacttcatgtttatacatatgtatgcatacacccacaggcatgaggaaaattttagatgcaaagctgacaacattccaaaatttttgtagaaatttgctaagcaatagaaatatatcagtgaaaataatacaggagctaaatttatacgtcagtttcttgctcaccaacgcagtttttcaatatcaaggaagtgaaaaattaaaccagcttcctccctccctcccttattttctttcttcctttctcttttcttctcctcttccctcttcttctctgcccgcaccctctcctttttaacttttatttgcctgtttgcctttacttttattttcaaagccctttgaggcagagatgaacttctggcagaatgtctaaaattagctaggttctctggaaatgcagaactatttatgatacagttggctttctcagtactacagagagccaataataaccactcttaaatgatcctgaatgtggctagtatgcttcattgttgggaaatctgattttattaccctcttagattctatatttttaatgtattttgtaaccaatgagatttccacaagaaataaggatttggccttccccttgatgagtcaagcctgcatattcccctatgagtcatgagtctgcatattattagattggagttgttcctgctagatacaggccaaatttaccccaatttgaaaatatcaaacactgtaatcttaatataatattttgatgtgtctattattaggaatggccagagcaaacagttgagatctgtaagttcatatttaggaccaagtttccatgctctgtgtagagactgagaagcgttctgagcctccatcagcagctgttgcgtccactgaataattcattcaggaaacaaggactgagtacctttcatgtgccagattatctcgaaggctctggtgaccttaggatgaacaaaaaattatgctttcacaagtagaaggaaacgagtatgaatttgggaattgtctgcctttacattatagattgcctctattttctggtgggagtttagcctcatgatattggtgagagccacagatcctgaagggcatgaatttaaggctcagctatgctacttcccatctgggaactgctgttaaagtcggtaaatgctcaagaaatcaatcagaggcccttctcctcgttcttctttattttccatcatcaccaccatcgtcacctataatcaccatgatgatattagatattggtgcaagtagaatcagagatgtgtattgtttgatccaaatattgtatgttgcaaattgaaagtctgccatcctataaatatgaaggagcagttagggagtttcagtaataagcaaaaatgaaggtaagtaacttggactagtcagccatttatgatggtaataataataataataataataataataataataataatcagaaataacaaagtaactgtgaagttgagatatttgaagactagtcccagtactaaggtgctttggggcaatgcgcagttttctaaaagtaatcattttcttgggttggacacagaataaatttttagtactttattttcctggttcttcagttcaattttgctacccaaacttactaccaattatggtttctttacttcaaaattccaaagctccccagcaatttgcagggtgagattttgtgtgactgctggaaggcacattccaaaacataaagaaactttgccattggcagaaatggcctttctgggacacattcatcaaaaatgtgaaatgagaatttaaaaagccgcaacatgccgggcgcggtggctctcgcctgtaatcccagcactttgggaggccgaggcgggtggatcacgaggtcaggagatcgagagcatcctggctaacacggtgagaccccgtctctactaaaaatacaaaaaataagccgggcgtggtggtgggcgcctgtagtcccagctgctcaggaggctgaggcaggagaatggcgtgaacccgggaggcggagcttgcagtgagccgagatcgcaccactgcactccagcctgggcgacagagagagactctgtctcaaaaaaaaaaaaagaaaacaaaaaagctgcaacatgtggcatcctccaccactcccctttggagcccaagtgacaagaagagagagtactttactgagaatcattttgtttagaccactgtaagacttaaaaaaaattaataactttatttcttaagtcggtcaagatgaccttgattctggtgattagaaaaccctgtgtctcctgaactccttgccttctttcaccctactctccctccctctgtcatttcttcccactcttatttcccactactcatcatgtctccctctctttgtctctttgccttctttcacatctctgttttttttctatctctccctcacaaatcaatattctcctcagtagtcaccccataaatgaagcacaaacacacatcaacaaaaatgtgcacaaatacatgcggcataaacacacacaaactcatttttgtccacattgcacagtaaattatcagagacttgataatacttgttaatgagctcagtcacgcttattattcagtcctatatcatttttctacacccaaatgaacaagtatggttgtagagttttggagagagagtacctgctctttatcaaacctgtaggaagattctctcatgaccaccatgttatttcaggcagtatcttccttccctagcttacctgtctagcaatagatttaaaggacatatgtaaagagaaacttaaggtcataatcttcaggactcacaaaacaggtatcttctcctgtggatcctaaagcttatacattttcttggctctcttcaagaaaaaaaacaaaacaaaacaaaacaaaaacacaaatttacaagcagagagaattcaccaaagttagcagagactgggagatccaggtcctccttttgtgttctttttaggcaatgcattgaaacatgtttgcatagagagtttcctgattgcaacctggcatctcctctctacctgcaattctctgcatttcccatcaattctcatcctccttagagggttgaacaagagatgaaccctgaagcctgggctccattctctgcacagtaagtccacctctgggaggcaataagcccaagttccaaccttcccccttaggtggaaggcagctgtgacaatgagcttgggaccctagcctgcatccacaatatgttgccagtccatgcacatagctcctcctcccacaccccaaggtcctcaccagtgcctggaaaacccatcatgcttcagcgtactatggccttaaaacagctgcaacactgtgactcctttgtctctttcttagttatgtcactctcagtaagctccagttgttacaggagaatgaatctctggctgggaccttaccttgggtggtgttgttctcattggttgaaatatgttaatgtgatcgaaaagcccagagtatctggtctgtttttagctaaatatggattaaggtcatttcagaaactggctaaagcaagcatctttgactccccgttaaggagcagattgccttgaaagtctttgatctagcctggatttgtcatttttgccactctgaagatatatggagcagtggattagtgactgtcattctttggaagcactgctgaacagggtgcagagcttggacttcaggttggacagctctggtttctgagttccaatcttgaccctgtcattggctctgtgacctcacacatgtggctcaacttctctcctctgtatttcatcctttgtaaaatgaggtaaacgatacttcataggtggtaaatacctgattacagagagatgaaccaactcagttgaaaccacacacctattcaaaagtagaaccagaattagggatgctccaatgtcacatgtgtgattcctctacaagaacaagtgggagataattaggcagcagtcaaaaataatgtgaagctatgctaacatctatttatcacaggcaaagttttgattaattaaatgagtgagaactttgttctttggcttcccctactctcttcactgtctatatctccctatccatcctatatttaaatggttatgtttcccaagtttcgggcctgaactcttctgttttctttctaggttttatccttactgatctctaatatcagcaaaatttcagttgtcttctctggcgtgtaagttgtaaatttgcttttttaagaaagcccaaatcatgaagatgattttcctgagacagtgaagactaagctgagccagaaagaagcaggcctcaagcaggcgagagtactaggaaagaaatgttttaggcagtggggacagaaagtgcaaagggtgcctggtgagaaggagctgaggccatgaggagaatggaggacaggccatgtggccagagcacaggagaggggtggcaccagaggagactggagaggaggaagggggcatctttttatattgattttaaggaaaatggggtattgatttgtttgaaaatgcacctgggtgatagacatgatcagatttatggtaaaacaaacaaaagaaatatgtgaccccatggcaaacagaagatttcaggggctaatgtcaatgtggagagtagtaatgagctttctgccttcatttacgactaattacagcagcttgggtgatcatggtggtggggaggagatgtaagggggaatgctgcagcaggtcctcaaatattgtcattttgttagactattgacaagggaaaaacaaaacaaatcaaaacaaaacaaatcaaaacaaaacaattccaggcctgggcccctgcctgtgtggagtttgcatgttcccctcaaatctgcatggtttttttgttcgttggtttgtttgtttttgtgatggagtcttactctgtctcctgggctggagtgcagtggcacgatctcggcttactgcaactttcgcctcccaggttcaagcaatcctcctgcctcagcctccctagcagctgggattacaggcatgcaccaccacacccggctaattttttgtgttttcagtagagatggggttttaccatgttggccaggctggcctcagactcctgacctcagatgacccacctgcctcagcctcccaaagtgttgggattacaggcgtgagccaccgtgcccagcccttcatgggttttctcaggtattgctgtttcctcccacatcccaaagatctatgcatgaggtcaattgctgcagtgtgagtgagtgtgggtgcatatgaatgagtgcgccctgagatgggatggctggcatcttgtccagggctggccccgccttgcaccctgagctgctgggacaggctttagcctcccttgactctgagcttgaataattgggtaaataattatcttactttttaaattcatctttcttaaatgtatatatagctcacatttgtttcaatggtaaatagtagaggtctttatttaaaattgtgtgatatttttgtgaccagaaataggcagtaggaacttaactcttatttatatcaattagcctatagtaaaattgttttcattatactgtattttgcttaaagtggcaatttctaagaacctattgatgacattaagtaaagacttactgtatttggaattaaggtgacatagattgctgacagatcagatgtgggaatgaaggaaagtgagaggtcaggataactccttgattctggcttgagtgcagaatgagtggtatgaggtctaccaggagagagcacactggagacaatccaaagtttgggggttgggggatggaagaatagcctcagctataaatcttcactgggctttcagacaggttgagtttgagatgactttgcagtcgggatccatgtgaagataccaactagaaagttaggtctggagctcaaaggagaggcctatgctaaaaatataaatatgtggagtatctttaagtaagtgaccatttaagccagtgtcatgaattcaaatgctcagagggaaagaacatagatccaggagagaacgatcctagggttcaagactgaaccttggaacttcagcaataaaaggcgggtttaggagaatgattgaattagtccagcatacaagatgttcaacagtgttgctgggcaacgtcagggtagccatatgatttcttgtacaaatgaggggccttttgaaagtgaaagagtgctaaccaggagtatcaaggcaacatgtgtaaactgggactctgtatggcaaaattagacaaagcaagtagttagatttattcaggttggaattgtgacagatatgcacaccaggaaaataaagagacaagagaactcaatatggaattagtcatcaaatgccatctagttgacattcttgcctattaatctcttcctgcatgttactacataaactttccacactatgtattttttcatattgcctcatttttgttcaaaaacaacaatggctctcagttgtcagggtgagagtttagaatccctagctaaaaacccaaactcttagttcatctggcctatctttttaatctctcatttactttaatctctcattagctttcccgagagtcatatttgcctttttactgacacttaaacatggcttaagtatcatcttctctagacttttaataagtaattgaatatagtcccctttatgatcccagcaaggaatgagccttattgtctatcagtcatttgaatctactaggaggatggttcatccagcactctatatctgataacatcgggagcatcagtttccagggaagtacattcaggtaaagtgagaatgttgtgctggatgcgaagtctcagatctctcagatgaagtcccgttttgttccccacccccacctgccgtaatgaattctttaaccacctgatgggttctcctgcccactgcacaaacaaaattaattcacataattgcagaaaagaaagagtttaattgacatgaggccggccacaccatgggggagagggaattattatctcctcaaaggcttctagattagggggttttatttatatttatttatttatttatttatttatttatttattttttgagacggaacctcactgtgtcgcccaggctggagtgcaatggcgcgcctcggctcactgcaacctccgcctcctgggttcaagcgattcttcctccccaaccccctgagtagctgggattacaggcacccgccatcatgctggctaatttttgtatgtttgtagagatggggtttctctatgttgacgaggctgctcttgaactcctgacctcaggtggtccgcccacctcggcctcccaaagtgctgggattacaggtgtgagacactgcacccggccttggggtttttcaaagattgtttgggggaagtgatgggagtggctagacaatggttgtttgttgctgattggttgggggtgaagtcatagggttatgggaaatgttcctcctgtgtgctgaatagtttctggtggggccacaagagcagttggtgagtccaggtgaagccaggtgtcagacatgcaaagaacccgaaaagacatttcaaaaggccaatcttaggttcaataatagtgatgctgtccacaggggtaatcggggaagttagcataccttttgatctcttgaataatgactggcaatcctttatgtctacaccttagcagaattcagccccctctatctgcctagcctggtggtctctcattagctttacaaaagtggttgagttttggggaaaggctgttatcatttaacctataaattaaatgcctcccaaggctagcttggcttaagcagccaaggaataattaaaagcagtttgaaggctcaaggcaagaggggagttggctagatcagatctcccccactgccataattttctcactgttataatttttgcaaaggcagtttcagttctagtactctatctgggatgtaccttacttcacttacaaataagcacagatcatattttgtatctacataactaggcaagaaccatcctgaaagggtaacaaattctatgaatccatccaaatataaaaatattcacacgatgtttctgtaattccacacagttagaaaaaaaatcatataggaatcagggaggtgtattctcattcaataatagaaacaaaatgtctttattttgcttaaaattaacaggaaaaagcaacagcattgcagtaaagaaagagtttcattgacacgaggccagccacactatgtagaagagggagttattataggaatcaacagaaaaaagtcccagcccttctgttcacatgctttaaaaaaaactatcataacatcaaaattgaacttctgtcttcattaataatcataagctaccacatattatgttgattaaaaaaaaattgaaacatctgcttggattgccttaaggaagactaacctgttttcctgctaagggtgtttgcattctttgtaactctaaaggtgaaaggacatcaggggaccgcccccagccaccctcttattcatgttcctggatcacagaaaaaggtgaacatattttggtctgccatttctatttgtggtttttttgtttgttttttttcaagatggagtctcactctgtcacccaggctggagtgcagtggcacaatcttggctcactgcaaccttcacctcccaggttcaagcaactcttctgcctcagcctcccgagtagctgggattacaggtgtgtcccaccactcctggctaatttttgtatttttagtagagacagagttttgccatgtgactaggctggtcttgaattcctgacctcaaattatctgcccccctcggcctcccaaagtgctggattacaggccggagccatggcgcccagcctctatttgttattctctagtagaggactctgaattttgatttttttctttgaacgtttttttttctattgtagtttggagttgcttttaaggggagttaacgcatttgttgggctctaggtcactttgaggcagagaaaacttcaatcagacctcttagttttcttagatatctgaactcttaatctggagcatgcattttgtaatttaaataaaacttttccctttattttcttcaaaattatctttctttctttctttctttctctctctctctctctcttttttttttttttaaaagcagggtctcattgtgtcacccaggctggggcgcagtggcatgatctcagttcactacaatctcgggctcaagctatcctgtcacctcagctttgctagtagctgggacaacaggtgtgcaccaccacacctggctattttttgtactttttgtagagatgggggtttcaccatgttgcccaggctggtctcaactcctgggatccagcctcagcctcctaaactgttgggattataggcgcgagccactacacctggcccaaaattagtttcatttgagtttacatggggtggttgaaagttttggggagttttttgtttgtttttggaatcagtttcagactatgcactttttggtactgacacttttacacacaacaagatcattcatgcaaaaatgaagaaatagaaaaatgaaactcttgcttttttctcatctttctctggcttttcttctcttatggccattttctccctctttcttttttactgtctgaaactcttttcatagacttgaacactgcttagaattatagaactattagcaggggcaaattgtatgcatctgcaatactacctcaattcttgatcctcagaagaaagaatttgaccaagggggtgtaaggcagagtgagagactgaggcaggttttagagcaggaataaaagtttattaaaaagttttagagcaagaatgaaaggaagtaaagcacacttggaagggggccaagtgggcaacttgagagtcaagtgcactgtttgacgtttgtcttgggttttgtatgttgcatgatttggtgggttgccttacttctccattgattctccctttggagcgggctgcccacatgcacagtggcctgccagcgtttggaaggggccacatgcacggtgtgtttactgaagttgtacacatgctcacttgaggtctttttcccttaccagccaagtgttctaagaggaaggacatataccagttaaactccgccattttgcctcttagtgctcatgcttgagcccacacacataactcctgagatcttatcaggaagcggctgatcaccacttcaggtgtttcctatctattgggagactgcttttccctggtcactcacatccgtgtgaagagaccaccaaacaggctttgtgtgagcaacaaggctgtttatttcacctgggtgcaggcgggttgagtccgaaaaagagagtcagcgaagggagataggggtgggaccgttttataagatttgggtaggtaaaggaaaattacagtcaaagggggttgttctctggccggcaggggtgggggtcacaagatgctcagtaggggagctttttgagccaggatgagccaggaaaaggaatttcacaaggtaatgtcatcagttaaggcaggaacagaccattttcacttcttttgtcattcttcagttacttcaggccatctggatgtatacgtgcaggtcacaggggatatgatagcttagcttgggctcagaggcctgacacctggcactggcttaaaccaattgttattttagaaagacagtgtgacaactgcctgaccatcacccgacggtcgcctgacattcttagattgggggcccctctcctgctttcctcacgcctgcctgactacctactccaacagagcaacagcggacattaccagagtttttttttgcctaagagatcactctgcctccaggactgtgggttctgatgcctactgcattttatggagctcctttcctcagaagagtgttgacaggataaaaacaaatcctgggatcatgtcttccttgatatttctgagcaccgtgtatacatatgtatgtaatgatggactcacaaatatgccactcttatactcaatatttgaggtggacaatctgacattggaaatgtagacattgttgttagacctggatttcaatttttatgctttgttttgtgatgttgactgggctgtattaaatgtcttgagttttagtttcatgatctacaaaagtagagttataatttgaaggagaactgaaaggacttgatgagatgaccattgtgctgtcttgtacatagtagatgctcaggaagtgttggatcttttcttctcactccgtctgactctggactgttgtatagtcatagtcaaaaactttgtagccaaggtctattataaaactagcatattcatcataattatggcatttcatagcaggtggtatgtcacgttcaatgctcagctaagtaattgtttaaattccatacaaaaaacaagtatttttcttactctagtgaaaagaaaaatcttgcatttacaaaatcacttgaaataagaatttctggtatctaaataaaggaatataataatataatagttaatatttacatagcattttctgtgccaggaactgttctaagtctttacatatattagctcatttaagtctcatgatgactggctgcataattagtgaggtcagtccagtgaaaaataatgcaaagctgcttgttcaaaaattattaagaattttaacatggtgatgccagagcattaaactaagagtggggcctttctgattacagggcagtgtacaaatacccaagtgacatatctcaatcttcatatcaactctatgagataaacaccattattaattgcagacaaaataattacgaagtggggaaaagctaactcacacaaggctacagggacaggaaggtttggagctgggattctacccaggtaattagtgttcagagtctatgttcttacctactggaaaaaaaaaagaaaaaagtcttttgtttatgtactaacctttattttataaattgcactatgtattttatttcagagctatgatatcaaaatatctattttgatatgatcatatagtataccatattcatctatatcaatgccatggtttgtacaaatagaaaaagatctgatgggaagcattatccatgtagctagttacaccaaaactaatatgaattttaccaatcaccaaacactattctaagccctttacttatattaacatcatataactgttaataccaccctatgaaataggtactattgttgcaatcatagtattttagatgaggacattgaggaatggaagacatatatcttgagcaatgcctcacatctaataactgctaaggtgaaatttgaaccccaacaggctggttggggtcttcaaggtactttatgttagtctcttgactgtgatgaatgaaatgtgccattgttttaattttatccactgctaaatcaccaataatcagcagaatgcctgacacattaaataaccaatcaatgtttgatgaagtaatgaatgcactgagtcctttgaaaattaaaattttaatcatgcaagtaatacatggacacatgcttcttctaaaatgctaataaaatagtctaaagaaatcaaaccataaatgtcttaccagaccactctcccgcccttgtcatgattttaatctttattctctggacttttccaggaaggaccaagatttccaggagtgttctgtgtttatgaatcgctgttgatcatgctatgagccgacagggttgacgtttgctctgcatactcaatgcagctcaatatgatcctgaatatggtgaagctttcttcagagccatttcttttgctgcagacacataataaatgccctagtttcactaggcagtttcagtggaattcaatttgaaagctaaaaatgatgcagataattataagcagcttcaattccagttactgtccaatccctgcctgaaagctccttgccaagggatgttagccacatgatcctgtggctgctcaaggttaagctgttctgggcaagagtttaaatgtgctgccacagggcaggtttacttctttctaaacaactcaggctgttttctctagagccttgaagcccagggtctagaccagacattacaggattttatgtcaaagaagagtataatattaaaacataattggggcatcgctcatggttgttaagactgacttgtgataaaaaatcatgtgaggaaaaaaaactgccttttgggtaagctttagaaggtggcaattaaggaacttgagttttggagcaaaattgccttatttgaaatctaccactgccactgttgactgaacaattgactgattctgtacaatttactatattttctgaaactcagtttcctcatttgtaaactggagataataattgacttacctcataaaactgtggtaatgtcaattgaaacaattaatgtgaaatacctaatatgctgagattctcaataaatattagattttataagcttcataaaattaaaaagtgcaggagaaacaatttcagaataactcagtccagttggaaatattatgccaatatttttgctgaaagctggtgaaatcttcagcagggactggcagaaacaccagtgctttactaggcttttcttgggcataatattctcctgaagtaaataaattgacaaataaatcaatacattgacaaatgtcatttgtcagtaaaagtgacaccttctaaaatgaaggagttactcttttggtttcattgctatttaatggtatgttcagaagtgaactgacttattaactaatgtgatctgagtgactgtgatggacattctcctccaaagctgatagagtgcctacaacacttcctgctctgtaataggcacaacataaatatatagtgatttgcaagccaccttttggaggagaacacttcccattgtttttatatcttctaatacaccagtgcttggtaaggtcctcacaagagaatgctgatacctgcatttctctttccctggtttcctgcacaggctatggtgggcgtaagctcagttctcaacaaccgcctgctgaatagaacactgggcaagggaacaaggggttttaaaggcactgatagctctcaagaggctgctctgtctgccaagagatgagagccatagaatcagaagaaaatttggagaataaaaggttcagaaaggtgactagagtaggaggaggaaaacaaagagactttaaagcgctcttctcttgaagcaccatgtcctctcactatttattgtttatcaggtacccttagactggatactaagcaaggctcgtcaccacaaaccttgtcacatgcacattgtcccttcctactctttggagctaccattgtgtttgtgaatatcacacactgttcacttagatatagatagatagatgaaagataagatagatggatagatagatgataggtagatagtagatagacagatagatagatagatagatagatagatagatagatagataatagattaggagatagaaaatgtctttgtatttatctggtgatgggaaatcttgaagtttggagtcaacctgatttagttagggtaaataatagtgcttgctctaacaagttgagtgaccttgtacagtttagtggaaatgactcctttatgggcaacaactgctgaatagttgattcattatttttaaaattatgtttaagagaaaagtattctgaagatccgaacatctcttaaatatgttatgtttgcaaacataggaatttattcaccagtcctttgatggagacttaaagcttttcttgtgtattggtgtactgtttaaatttcttacaaaactcactcccatatataatctatacatgtaatctatgatttctagcttcagtttctttaaataggacaaaaactaaaactctttgcaaattatgctgtggggaaaatttgacagatgtttaccacacaccctctcccaaacagatttgtgaaaatacagaccatgtcttaattttttttttttttttttttttttttttctgagacagagtctcactctgtcgcccaggctggagtgcagtggcacgatctcagctcactgcaatctctgccttccgggttcacgccattctcctgccttagcctcctgaacagctgagactacaggtgcccaccaccacgcccggctaattttttgtatttttagtagagacggggtttcaccgtgttagccaggatggtctcgatctgacctcgtgatccacccgcctcggcctcccaaagtgctgggattacaggcgtgagccactgtgcccggcctcatgttttaattttgtatttctccctccctccctttatctttcctttcttccttcctccctcccttcctctctttttcttcctctatctcttcctctctccccttgatcacagtatatactgtagaaccttgtatatagtagcatcatgaaataaaggaattaaattaataatgggtaacttgcctactgtaacacctaacaaacatataatattcaataaaaatgctgttaccattattgttgtcattatatgtatatatgtttatcattatgtttctacagaagcaaagtaaattggtgtctttaagataatattaaagaaatggctaaggaggcttacatgagattttcagcaaagttccaagaattgaaaaactataagtagcagatgcaacctagaattccacttaccttatagtgataaaagacactacattagtttaagtttactagcccatcctgttgaaatatgtgtgctcatatattttagtaatacttgtatttttgtggtgaaatggttatgcttccaaaaataacaaattccagtgattttagttcaaaacagttaagagctagagctagaaaacaactttcttacttgcattatttttctttacattttcctaaactatacgcaggcaaaaaaatgttgtggaagtgctgttttatggaaaaaagccctgaggtgctatttgcctgcatgctactgaactgagtttacatctttgcaaacaggaggcttcccggaatgtgctgtgtgtatatattcagagcgcccctgtgttcactgttttaagtattgggttagagatctcactaaacaataaagtagcattagctccccgtagacaggtaatcctattatctttagatacaaggatacattttaataatacagatacggagattaaagcaggaggattgagaaagcatcccattccctcagggataatgggtaatgtaatcatgctcttgcactaagcaaataaattagaagtcttgattgcatcacaatggaagagattcatacttccatttctttcaaaagtgatggcagtctgcttccaaactaaggccatttaacatgtctttatacattttttcctagtttttgaaaaatattttaaattgaacccaaaggcaaatacgtataatgctagttgatgctttgggggatatatctttctatagaaaccttcccttccaatgccattgaaaaccaaatttcaaaattgagcactagaagtaagccaaaaatcaattaccattgatggaacaaaaaaaaacagtacatttttgtcaatattactgctttctttttttcttttctagctttgaaaattaacccccattatgtatgacaatctctaaactaaagaaacagtaaaactcttgaatatattctttgtacagcctttaagtaattaatggagtacaacacagtggtctcgataaaagttccagaagaactcaggagggcaagagatgctgtagaaaggagagaggatcaaagctgtgtcttgcaaaacagaaaagattggggcatgaaaaaggtgtggagcaagcaaaggtccaaaaaattgttccagaaaaaaaactgactaaataggaatgtaggaagtatcaagggaagataatttgggcagattctgaagaacctttagtgccttgataaggaattagactttaggatatctggagtatctctcagcagggaaaaatcttgatagcaatgggtttgagaacatgaatatgggaagggagggtaaggcaagtcatctacgaagtaagaaggccttagttttgaatattaaatgataaataagaaaaaatatgaaaaatgaacaagcaagactatgtagatggccgaatagacagaggccccccccaaaacttaaccacaccctcatctccaagagcccaggtgttttttcctatttatcatctcagctgctcaatggctcatgcaattttaaagcaagaagaaataatgaaataatgatgaagcagatgcactgtgtaagtgcacacagggatgaataaattatacaaaatgcactgcagttggaaggaaggaaaggaattactgaaagaaagtagcttcatggttttctcattgagatcaaactcagtcctgctcagtaaaaacgaactaagtactcttggtctggaggcctgaccaggaccttaggaacttgtgatacaaagactggaagttgccctggttgagtcagtgagtgagtggtgaatgaatgtggaggcctagcacattactctgtacactctgtagactttataaacactgtacagttaggctacactacgtttgtaaaaaaatattttttctttaattgtaaattaagatagcttgctgtaacatttttactttataaacttgtaattttttttactgttttgtagtaatacttagtttaaaatacacattgtacagccatacacattgtacagccatatgaaaatattttctctctgtatatctttatattataagcttctttctatgcttataatttttgttttattttctacttttaaacttttttcttaaaagctgagatataaccatatacactagcctaggccttcatggggtcaggatcaccaatatcgtcatcctctactacatcttgttccactagagggtcttcagggacaataacacacatggagctgtcatctcctatgataacaatgccttctcatggaatgcttcctgaacgaactgcctgaggctattttacagttaacattttttcttttaataccgtgtactcagaaagagtatactctaaaacaaccataaaaattatagtatagaaaatatattaactagtaacagagtaatttcttatcatgatcaaatattatgtactgtacagaattgtatgtgctatgctttcttttttttttttattttttattttttggagatggagtttagctcttgttgccctggctggagtgcaatggcatgatcttggctcactgcaacctctgcctcctggattcaagcgattctcctgcctcaacctcccgagtagctggaattataggcgcccaccgctacgcctggctaatttttgtatttttagtagagatggggttttgccatgttgaccaggctggtcttcaactcctgacctcaggtgatccacccacctcagccccccaaagtgctgggattataggcacgagccaccgcgccctgccccatgtgctatacttttataggactgacagtacaggaagtttgtttataccagcatcaccacaaacacatgagtaatacagtgcactacaacatcgtgacgaccatgtcactagatgatgggactttttcagctccattatgatcttatgggaccgcagtcatatacgcagtctgttgttaactaaaacgtcgttatgcagtgcatgagtgtatttgatgcaacacagtcatctcaggaattaaagtggctgtgtctaagtcccagtagccctccgttttgacttatttccttttcctcaaaaattagatgccctttcaacctggtttgacaaaaatcactgaaattgatcaatgcatataggttttgggtctatgaaaaaatgcatattttagctctgaagagaacgataacagaacttgactgggagttgtaaatgtcagtgaataacgggttatgggacatgaagcatattttcagatttctcagagaaccatacttgggtccaaatgacttcatgttaaagaaacggaataaaatcaactcagcattcctgctgaccagctttctatctcagtaagtaagtcatcatgccctccggagcaaccatcttaggtcaatcaaaacatttggcctcattaaccactttggatttatcttaggactttcttatttatagtcttcccaaggcataatgggcttcaaaatgtacttttccctggttcatgttgagttgaaccaagttctgtgcttttactcagcaggcagtcatttgactgtcagcttttatatttttctctatgatcaaggagttcatacggctgctcctaggtgcctaattaacattcctccatcactgcatccctgcttgtaattattcttcatgccacctttgtttcctcaaccatcaggaatatatcaataggtcaaatcgttttagtacttctgacttagctcttctttaagcttcataattattagatataaactgcagataatacagatctcttatttcagcagattctgtgattctgctttttgtttgtttgtttttgtcaggagagaaattggactaaattctgaagagtggccatggtttgggaagatagaagagggtgctgcatatagggatattaggagcagagctaaaaggcaggaatcaagttgcatgttggtgaagatatgtgatgtgttcggtgtagagaggtacacccttgaatttgaaatgtaatatggtggggggaggggtggaataatataaaccttagaataagagtaggtctaggaagctggtccccacatcttcaactcaccttacagccacccagcaggcagacttatctcccaaatctggtccttttactctcttactctggttctttcaatgagactccagtgccttcagctaaatttcaaatgatttctcctgccattctagacattgcaggtcccagcacacatgagtttcctaaactaatcttcagtccttgctctcctgccaggcacctcacatttcagccacattcagtacatccttgaactcaccatgaacactcatttccacattaccacccatgtgctcacttgctcttatcttccacctccagtgcacttataaactcctacacagtatataagatacaggtaaaatataagtcattgtttgtatcattcctcagtcatagctatttacttcactacatgtacatccgatacccttgaacatatctgtattacaccatttaccacaacgtattatatttatgtacttacatgtctaatctgccacctagacttgagctcagcgtttttatttatccatgttccccttaaagattctcatatgcctgatagatggcaggtacctaatcgatgtttgttaaagtgttttggatggagaatcactaccatgttctttcctaaaaaatcccaggaattggtggtataacatgactggtcattgttaattaatgttttctactagagattgttcttagtcagtcttcatgattttttttggttaacaaatattttggggattttaatggccaaaattatttctaaaaaattgcttctgtggttgttggtcattcacttagaaaggatttactgaacacttccaattaatgagctaatttcagttttctgaatcacaacaatatttatttcccaagaagtaaacaaatttctgcatataaattagaattttattaggtagcagttttataaatcatgtagtttagaatggcattctcctagaacaaatccataggtcttttttagaaaaaaaaaaaagaaaagaaaagaaaatgtcgcctcaataattttagatgtaatttccatacacattttattgttgtgtattataggttgattactgctcctgatagatttttaagttgcttaagcatataaaagccccaatataattttccacagatagatggagagaaagaactttttaaacgcaactctataatttgtatatctgaatcctgatcttttaaagctttcttagtgttttccttagcagaaaaaatgtttatcattagaactgttaaggaggaatcatatctccttttataaagtgctttatttttcaaagtaaaggaaatgcgagatggcaccttataaaattgctgatcaaaaatggtcaaatgttggcagtttcatgtggttcaccctaatacttacagcttgattttttgagaggaaaaaggattgaaggacgtaaaaatgttatcttccagtaatctcaaaagatacctgagagagaactatacagtgaatgctgatgtactgattatgaaatgtattttcataaaaatgactgtaacctggttaaacaaggcatttttctcctggattctgcacacactagtagaataaattcagttggtttccattcctctgtcagttagtgcacgtaagtctcacccatttgtaatgtctagaaatcttaaaaagcatcagaattaccattaatgatgatgatcacagtctgctagatgcccaggaatgactaaagcctactactaaagccccagtagcagtcaatataggttatgcttcaataacaaacaagtacaccaaatccttatagcataacacaatgtttatgtttaaaattgtgatatgagttgaatgactttccagagcagattttggagggggagaatactcaattatgtacttttcattaccacaaactgaagtggcacattctcagttctagttacattttatttgctaggactctggtctcaactaattggaagacgaaagtgaagtacaatgaatgaagaaaggagaggaaaatcagatatggttgagcactaaacatctttaccatagtttgtaagactaaatagacttcgtacattttatttagtatttttttcattcttgcttggggaaatctttccaagatacattgccaaactggggtaaatgaagatgaaagaaagtctgagacctaagaggttgaatttcttgaaactattttataatgaccatttccttacttctttttgccttgttgattctttccttgttcattctatttaccacaccagacataactccacatagcaagattttgccttgtctgatgccttcattttcataatttatttccacacatataagcagaatgggttacaatggcagacagaaatctttagctttgaaatagaatggccagtgagaagcatgcctatatgaagaatctcatatagagagaaaatttaaatttcaatagagtgtttttcttaaacttagaattggccacttttttttttttttgtcatttcttttcacttcacaggaacatagggaaatcttaacttcagaagcaatttgcgtgcaatctctcttcctggatgggtgaggattgcccccttcagctcctgctaagctttatcaaatggagaaagcctcatttcatgcaggcaggagtggagagtggctctagtgtgcatgctatcctcatcctccaaaatatttcacataaataatatgttaccatcagaaacataaaatatcaattatatattataaagcagaatttataattctacatagagtgtaactgagcaaaaattccattgaggtataaaaacagaaaatgcaaagaatctttgctcatatgaaactgacaacatgccatctccccttcatatgactaaacctgctctcccaatcccattgtaccatttggagagatttacatcaatccagaacaaaaattactcactttaccttaagtattgttagcttccttatttcattgtatttcttcagttccttcagtttgtttttaactgaatattggtttctattggtttcttcagttattttttaaatgatgtaaaaataaagtttatctcatatccctattaaaatctctcaacactcatgtctccctgacagcccctgctcattctctttcttccagcctggtacttccttcacttctctccttcctcctctttctccttcttctcctcctctttcttctttctttttccttgtctttctcttgtttttattttccttccccctcttcttccctcatctggaagtggcttatgatgcacccgaatcagaatcccgacgaacaaaaattatgattatctcaaccttaagaaaaacagctggattctagaaaaccctcaaagaaagtacgagatttgggaaagaagcacaaatgtcccccaagtccctaccccactctctcatgccgagaaaaaacagcttcacaacacaaagcttttatgaagggctagcagttccagtgatgggctcctgagccctgagcctaactggtgcctgttgacctcactgctgttcaaatactgtcttcttgtcctaaaattagacattacctttatttgattttctctggcactgtctgcctgccaaccagctgcctcccctgccacccccgcacacactggtgatgcattccagatccaaatccaagtcctggttgctgacatgattccagatctcactgactgtgggatttgtctagaattatgaggccaagtctcatattttgagatatgaagaggacagaaacataaatagacccagaacaggatctcagtgttacttttttatctgtgtgaaggacaacgatctctccattttattctctctttaatacctatttccaaacataagaaactggaacttatgatgtgcctatagtgtcaaacattgctccaggcatggtacttgcactgtcttgtttaattctcacacaaacctacacaagaactgttatgattctccttaattgatgaggcgccaaagtccagagggatcaagtaacttgcaaaggctcacagtcatgtggctgagcagaggttccaatccagggcatgttagtgcacacgggctcttccctagtgccataattcctcccctcaaataagattttcctggtaatttgtgttttttgaaccaataagacttaccctaataaaacaggataaaaggtaacaattggcaggcgcagtgcctgtaatcccagcgctttgggaggccaaggtgggtggatcacctgaggtcaggagtttggccaacatggcaaaaccccctctctacaaaaattagccaggcgtggtggcagagcctgtaatcccagctacttgagagtctgaggcaagaaaatcgcttgaacccaggaggcagaggttgcagtgagctgagattgcatcactcactccagcctgggtgacagagtgagattccatctcaaaaaaaaaaaaaaaagtaacaattaattccatttatatgggaaaactagatatagagaatgtatgcaatttgttgactcttttttggtaaaaagaactagtactagaaattcaaactttcaagcttctagttcagcactttttcaatgatattgatacaagatattttgctccttagctcagctaatctgggttcttgtctcaagaccaggaagaattaggcatgcagacacattgaagggtgagaaggatggaatgtattaagccaaaaagaagctctcagcaaagagaggaggtcctgcaagcaggtttccacctcccaaattgaataccagggccaccacacaggagacaaagaggccgagctccttccctgcataaggcgtgaattcctggtggctccaccccattccccaagtacaggtgggcctctagtccattgtgggcatgcccaggcaagccccctgtgcagttccctcatctgcacaaaacatctggtgtaaacacttgtgggatgggttggagattctgcagggattcttccgtatctgcgtaggcctttgtctgcctcctgcctctatcaatatcttgatgtttagaactgaggggaaaaatatatggtaatttttgagactgtgaggcagagctacttccttcactgtaatattcatggccctgaatgctggccaacagagggtcaggacacaggaagggaagcagcatcttatagatgggccgcccctcaacactgtttgctgcgctactcgatgtcactatagaagatgttgctctaccccaggttgcctctgcccactcctgtcaatcttgtttttcacaattaattattgacctatttgatcttcctaatttccaattagccacattctactttgtccaatttccccaatcctatcccttagtataaaatcctgctaaattgcatttttttcaatctccctaagtaatgtgatacatgatgtcaagccaacagcattcatttattttaaataaacttacagctagaaattttgtttctttaaccacattgctagacttgaataaagtattttatttaatgaatggacgatgatgataattgcattttttaaaagagcaaaggaatcattaggtattgcctgttttccaacaatactagattttattttaaatatgtcataattatttctacctgaagagcactggcactggagctagcctgccctggtacacatcgtggctccatgtcttaccagcggtgtgactgtgtgtgagttactaaatcactccgtgcttaggttttctcctacaaaacaaagataataataattcctctattatataattatggttagatgcaaataaaattgtgtccagaatttattccttctggtgggttcttggtctcgctgacttcaagaatgaagccacggaccttgcagtgagtgttacagctcttaaaggtggtgcatccggagtttgttccttctggtgggttcactgacttcaagaatgaagctgtggaactttgaatcgagtgttacagctttaaaggtggtgcagacccaaaaagtgagcagcaactagatttattgtgaagagtgaaagaacaaagctccctcagtgtggaaggagacccgagtgggttgccactggtggttggcatggccagctttttattctcttatttggccccgcccatgtcctgctgatttgtccattttacagagtgctgatttgtccattttacagagtgctgattagtccattttacagagtgctgattggtgcatttttacagagtgctgattggtgcatttagaatcctttagctggacacggagcgctgattggtgcgtttttacagagtgctgatggatgcatttacaagcctttagctagacacagagcgctggttggtgcgtttttacagagtgctgattggtgcatttagaatcctttagctagacacagagcgctgattggtgcgtttttacagagtgatgatgggtgcatttacaagcctttagctagacacaaaagttcttcaagtccccactcagcccaggaagtccagctggcttcacctctcaaaatgatataggtttgggggaacttttaaaaatttgggcagattattttttggcagttattttttgttgctatgttttatcttcacgtgtttgtgtgtgtgtttgtgtatttcttaagaatactcaaacttggctgggtgcagtggctcactcctgtaatcccagctctttgggaggtcaaggccagcagattgtttgaggctaggagtttgagaacagactgggagtatagtgaaaccctgtctctactaaaaatttaaaaaattatctgggtgtggtggcaatgcctgtagccttagctacttggaggctgaggcaggaggatcctttgagcccagaaggttgaggctgcactgagtcataattgtgccattgcaactctagcctgggtgacagagtttaaccctgtctctaaaagaaaaaaagaaagaaatgctcatgttcttggaataaattcatttttataaatttattcaaattagttatacaaaaaactatgaggaacatatgtctgtaagaaggttcatacaacctcattgaacatgattgctcctagtaggaacttaaatagataacataagacaacatcaataggattttaaggcagccatttacaattacaatctcattttaaggcagccattttaaggcagccatttacaattacaattacaatctcaaataataattttataaaatagaatattgtatattatttagaaaacaaattacacaaatgacttcaatttacattaaaactcatatgtacattggacatgcagtaagaatatgaataacttccaaattttctgcagcgagcctgtatcaatttaaaatcagaatttatgtgtatgtatttaaaatatatatttaacgtaattctaccatctgacctagtaattcctaatcatttaatgtcccatctaattctttactgttgagtaatttgatttccgatactgtaatttattaaaataatgaagaaaaaggaaaaatatgtactaacatgtaaatttcagcatgatatataagactagaaaattgaaacacaaaggaacaatagtcacggaatcgttaaatataataggatcgcagtttaatatacgagtatgaaaactcatatgttaagagagaaaaactggatacagctatatgtgtgtgcatctagatatagactaaaatatatttttaaaatcctatggctatgactagataaagggctagaagaaaatttttgtaagttttgacagtaattacttctggggagaggtgtttctgttttctctctattcttcatttccaaaattttctcctattatgttatataaatttatagcgaggaaaataaagatattttattaaatgtaatttcttaaagaaaatattttattttccttcttccattgacaagttctctaaggtaaattttttctgactcctcccagatcacgtgtccaccattttattttatctagggaatgacaacctcacttatgtcattttgaagtactgcattatatgatatttggggggaatggcctctcccttaaaacctttacctgcaagcttcctctggagtctttttgagtcagcacctccatctgtggtccaagatgaaaaaggatgtactaaatcaccttgacagtcgtctgtttgcattatatcatcagtccctgtcttatgtgtggatgcaacatttcttcaatccattctttgcctctcctaagtgcacacattctcaggcagaatggagaatcactttttgttttgctataaaacacacactgacttttgagacaccttcccagaatgtcccagcaagactattattaatttttaaacagagataggactcccaagaaggaaaaccaggccatggtttacttcgcataatttaactgcttaactcaaaatattttccctagagaccatcacggtagtgaaacttttcctattataccattcattgacaaatttgtaatcatgatgtatgtgtatatacttatagtatatatttaaaatgggcattctgaccttgtagtttataattacaggattaacaaggctgaaaggaaattatgtaaattaggaaataggacaagagtgagggacaaacctggaatgatgacaagcacagggaaagatggttaagggaaaaaaaaataacttcctcttttgctgatttccgtattgtctagagctagccatacttagaccagcaaataagccaatctttttctgatgtttactcagcattttctgaggctctcctagcaacaagagtgttgcagggtgctggtcctgagaaggccaagcacatgccccctttgtggaactcttggtcaaatggaaaaaccaagtccaagagtcaagcaaaaggccaagagttttgacagaatgctcacaggagtgtgttcaactttacctgggaaaaagaaaatgagcaagcagagagatatgactttgtcttagtgaatctgaccgttttcaagtaaaatgtatagcacatactttgtccagtttgaatggtgatatattgcaaattaaatgaattacttaaaggccactgtttatgatttaatctatgaaaaacgtccctccattgcatttctgcatacgttaggtacttctgtcagagcatcttattctgctagtttgtttacacttgtttctctctcttctgaactgagactttcaaatattatggtacaactatcagatgctgatatataatgcttagaaaatgtagatgaagtgggaaaacaaaaagtttcatatttggggtcttataaattgctcctgttttaaggaagatccaataatcaaacatacttacaccactttttgttgttgaattcaattggcataaaatgacaacacaaacacaattttaacatgattgaaattgttggatgatgaagtaggaaaaagtgttagggaagtccggaaaagtaaacctaaacctgcttaaggtaactggaaggaatggaagtggctgtcaaactgaagaaaagttttgtaaaaaaaaattacagagaaatccatattcccaaggtgatctctggattttgtccagaagactcaggcagctagccatcttgtgatgatcccaagaaattcgttcatgaactttttcttcttagagaggagaggatcacacatattcattttctatgaccagagctcagagatacaaacaaacactacgtccaattttatgtcagtagattgtctaaaatattcagagtctggatggataaaatattatattaccaacaaactaaaggacttgtgggtactccaacagcacgtgggcaattggaatgatatcctttttaacgtgactttagtaagtcttaaattgtgttagcagcataaatatgtgggaagtggtaggaagcagagaaaggaggacgcttgctggtagctgggtaggggcagggaagttgaggggcctccagacctcatttcagaaagtcattaggaatgtgtcactctgtaattggcctgcgtttctgggacccgtcagtatctgcctttttggatcaatgtgtgatttttgaggctgtgacagtcccgctctgagtgggttgcaggtgaagcacagttgccctgtcttacgaaagggagagggttggcaagaaaagtccatctgacattgtaaacagctaaatttatcaaggcaacccatttttcagctatacagaactgtatttctgtagctgttttttaaaaatattatctaataacctcctagatttttctcacttcctacctatggtgaaacatgtaaataaggagaacccaaaagcatctcagttcataacacgtttgatttttttgtttcttttctttggaaatgttcttgcatgaaccatttgcacaatgccaggataaagccagttcaaacagatgtgaattgctgacttgatcatgagaaaattagaaaaaagttacctaatgctagtgtaaaactggttagtgtgtgagggtgtgcttaaagaagcaggaaaattacacaagacgatatgagtaccccaccttggaatcttaacaggggaaaaagtctactcattaacatatgctttaaataatccaaaagattaaataataccatgataaaataacttacaattgcaaaaatgtatttttaaagtacaaaaataccagagaaaacatttttattgatctacgtaagccctattaaataaattattttgcagagacattatgcagtcattgggaaaatgggtttaaacttcagtcagactcagattcaagtcttagctctactgcactcttgttctatttcctaagcaacttaccaaaccttttggagtctcagtgttcttatctgtaaagtgctgataatataaatatctagcccacagagcggttgtgaggaacaaaggagaacacacataaagtacctgggttatagaaagtatgcaatgtatttgcgtcagtactgcttctaatagtactcagtgccactctccaaattccacaatatgcttaacactcaaacttatttgatgagaagatctatattttttctactataccacacctgtacttcacaatatttacattgtttaaaaaagcaaatgttggtctcattgatatttctatggctaactcatcatggaaatgttgaccatataaccttgtaatgtcttattaagaggaagtgggctttccaagggcaaatcaaagttttctgaaatacgaatgtattatgggtctctgaagcacatgggcattagggaaaacttcatcccaagatcctgaaatggattaggatcaatttgtgttaatcttgaagtaattgtctagcccagggaagttcctgttaagaactcacttaatgattgtggaagaaaagaaagaaaataaaagaaggaaagagggaaggaaggaaggaaggaaggaaggaagcaagggaggcagggagggagggagacagggagggagggaaggaaagaaggaaggaaggaagaagggatggagggaggaagtatcaataaattaattactagttataacacctgaggatcatcttcttgcgcaaattatttttaacgttctttagctacaggcaaagatcatcctcatcccaccacttttgtccaaaattgtagctgcatccttgttttattgtcaagctagccttaagacctcgttcctcccttctaaactattggccaattctttttttttatacttgaaaatgtgccctttatctaatacttattatagcaaatcatgtcgatctctaatggctctgagcagatgcgccctacttggtgcacttgttccactccttgatgcagagagactgtctctcttattttagccttttgcatttaatgctttatatttgccttctctcccacccctatggtccatggccccagtaagaaggcaatatccatgaattattcttctccagaacacaatactgcacaaataaacattttctgattttcaaaacatttgtgcatatatggatgatctgtgtgtgtgtgtgtgtgtgtgtgcattcaaagcacacagcatgatttctaacatacactatgagtgcataacttggtctatgcattgactcagatacaaaataataattcaggaaaaagaaaggtattcaagatgaagcaagataagccatcacactttgaccatcctcaagaagaaattcaacagggtaagtacaattagggatatggtatttcacgtgtggtggtccagcaggatgcagcccatgtgaacttactttcagcgcttgacagacattgtgagtgaaaattattttgatcaaagtcttaagttagatcgcacactaaatatggattcatctaggttacatggtagactgagaaatccattgaaaatttccgcccgagaaaaccagcttgaaaataatgtaagtcttgtcactcgaggagacttggacatattaaaagagtttgatgtggaagtttggaaagcacctataccaaactgaaatattgccaagattattaatgcatcactttgatgagccaagaatttccatctttccccatgggagggatgtctccaatagttggaggtggaaagagggcacagcttttattttaagaataaagaatttcaaaatgaagaaaagaattgcagctaggttttgacagagcctgttgagaagtggaggcaaacatgatgttttataaatgttggtattacaatcagatcacttttggtaggtgccttctgattgtctaattagtatgatgtcagctgggcttgagaatcatttcttttttttaaaaccatctgttttgtcataaaagtttctttagaagccatatgcaggcagagcatttatgcttttgttttttcaaagtgatcttctgtgttctttgtgtctacatcctgtggcataaatcgtagttttaaactatctaggaagaatgcaaggagtccagcagaagaaataaataaataattggccaattaaatcaattaattgaaaaatcagtgatcttggacacaagggaacacgtcacctttaactcgtgtcacaggaagaaattatgttttcaaaatggtgaggttttgaatcatattgccttctgagcctgaattttcctatttaaaaatgggagatttggtaaggaattaattaaactcacatataagaggacaatgcaggagaaactctatattataataaattatatattatagatgaagatattttataaagtcttaaatacaaaacaaatatcagttataacaattgtatatattttaatcattataataaacatttattaaccactagaaagcaagctagtatgagtcattaaaccacaattttctaccatttgttacttcaaaacttcttcccttgtcggtttcttgtacatgtttgctgaatgtgtacatacatgcatgcatacctcgtctttctcaagctagtgaggttaatgactataaaataacattttattttccctttactttaaacttttcccagcataaatctgtcagtcaagtactcctgcctctcgcttgatcagaattacatggttgttcttgagtccttttgagatcccaagagtctggtgacatatttgtaagtcacaaggaattaagaggtcaagaacatcaatatcagttcaggaatgtacggatagagccctatgatcaagcaagaaacaccagctgtaagcaccattcaacgtacttagaacagttcaataaactctgatggatgatgaaaatttcaaaagcatactctacacaaggaacataaagcaatctttttggatagtcaatttcttggtagtaatagtagtagcgttaatgttatttctttacatttgttgagcacttgatgcttttctaagtgctttaaaacatgttatctcagaatgtttagtccccaccagtgcatcccaatttgcagatattaactttgagctatggcagcaaacagctcaagatctacattagctttcggtgtctaagaaatgcaaaacttcctcattcttcttaccatgtaattttccaacatatagggatatattagaagcctggagactcagcaacttgccatctcttacaaaattaatgatggagttagtatttgaacctgagtcttctgatcttttcaccagcatgggtgctgttcaggctcacactttggatcaccctgtgaggctgatgctggctgtctgtgaagcagcaggaggaagagaaacaacccacagcacagaaaacagtgctgctttgaagagtgggtcacaacacgattgccaggctgtgatgcatctcatcttgtaaaagtaaatacttggcgatttccttgtggattccaatagtttctcttgtcacacactgactataacagctgcattcgcttcatgaaaatgggttagagataataaattgaccgaaaatatagaagactgaagtttttgaaagcagtatctggaaacaaattgtttataaattttacctctagaattttgaactccagagcaactcaatttaaaatttggaacaacgataattaccaaagaattttccacagccttaaactagtatttcccaccaaaacagtgatacttaaaatgcatatgaagtaatttattttaggagtattgtgcatattatgcatacacacaaacttacactactatgtaactgagaaacaagaacttgacaaggtgcaggtcaggctaggggtgagaagttggagtgaggcagatacagtgcgactggaagggaacgcagtccagaacagaatcaggtgttgaaactatcaggaagcagtgaattccaactggcacaagtgttgttgttgttttttctcatctccgacttgaaaactgaagggacacacgagtcctttgatgattccttgagtgatccagatgtactgagctggggatgttttggaagagggaattttctgagtaaataataagggacaatatctttgtatcagatgtacataaatgtgataaacatgctttgaaagtgctgtagtcaaattcttaaattatgataaccgagaaaaaagttaagaaaaatggtatatgtataataatactatgttcagactccactgtttctgccattttttttgttgttattttatctattttttcttggtctccttcctttcttctccttcctttcttaacccttccttccttcttttgtctttctctctctctctcgctcactctcttcctctttttctttcttactggcagtctgagtggtaagacagtgctgtatatacagaactgtatcatagaagggaacctagaaattttctagttcagagttttctaaaatgcattttataataaattagttgtatgagatatttttagggggttctatgctaacaaactgaaagaaacatggtgttttatattcctccttagaccttcaccatatatattggcaaattaaagatgaaacattttgcaattaagataactacttaattttgttttatctatttatttccaaacttacactcaatgaccctaacttggataataccaaaagaacttaaggagctagctaccccaaatcactgttgggggaacagacgatttattctatcttgctactcactgcaggaataacatgtcagcactaatgacacatatttgtgaatatgtgttttgggtactgtcaggggctctgagcaataatgaaggaagaaccattcaacaggcacccttttatgggtcagattcgttcctttagtgggctcttttagagggttttattgttaatttcctaccaacacacttgctacaatatattgtataagaaattcataagttcctgggctaaggcatttggcctaactgtctaagccgggatgctgtctgacagatttttcacaaatttatcacactgagtcattgtaagggaattaggaccacaagagaccttctttttggtcctggttaggatctgaacatcagatttctgtttaggcacccagaactggttaatcaaatcataatgactgtattccatactgttattcatcggggaagcatatttatctgagtatcagataagctaccttttaattttttttaactgctatgatgtgccacttaaacgaatgccaagactttgtgcttacaaaccttctacccacaaagaatcctttatcttacctttgcataattgacttatttctaattaaatgtggtatagaaaaaaaaagacctacaaaatttcaacttctatcatttgttccttcctttaagtctctgtgcttctgtaaacatgttagaaccttgagcaatgcattgtccatgctgctagctcttcctttcagataggtttcatgatacattccaccaaccacaacacacacacactcacacacaaacacacaccatccagatctttattctatttcccgattaaatgttcagaaaggcagtgcaaggccaacatctaagtgtgcaactcaagacttctgtccaccttgatattattcagcatttttgagggacagttggtagttacactaactataaatctaccagactatatcatactccttcatcttgcccacaaggatatcatatgctctgctaaaaatcaagaaacactctatctaattcttccagtttaccaatttaataacactaccaaaggaggaacttgtactagtttggctcgtcttattattccaatccatgagagaaatttgtaataaatcttcattgttttatgtcatgacactcccggtattatttatgcaattctgttttcactgccaatgtttcatatcaagtaaaaatgttttcatatcaaataagcatatttgaccactatcaggctattggcatctctttatcttctgaaattttgcaaatattacctcataattattctgaatgctatttgcagcttgtccatttgtaaagaatttgtcattcaaaatattttaaaattttcatgtttgagaattaattcaactcataattcaattttatagttgtttaaaatcttctttgtaaaagaatatgctcagaatattacatcaagaaggcaggttggacacatacacctatcttgtgcctatctcacacaaatcactgaataatagaaatcatgcaaaaagtaaaaataaattgataatagtgttcacaaacaattagggggcagcaatcatcagacagaaaatcctgaaaatgtgttgcatatggaattagtttgctggagaaacaagagtaagccttcatttacatatggaaaaaaactatagaaaagggaaagtcaggttctgtaatatttgaattttgtgatcaacagatacaagacaagccctctggactggtgcttctcaaatgtcagcgacacacaaatcacatgggaaaggtgtttaaatacagtctgattagaaggtctggggtggtggccaagtgtctgctttgcatgttagacaatgctaacactgctggtccttaaacatttctttgaatatcaagggtcttgatcagaggctgtggggggcagagcccagcaatctgtttgttaacaagtcctccagggcattcagatacatgcttaaatgtggaccctctagtagttaagtgaacaggtgcattgagttcagctggcctgttacctacatttaccacatttccattccctcccctaatccaagctgcagggtccacaagtgttttctctgaggcttaaaaccctgtataactctggtctcagaagatattaatcaatgaccctgaggagggcttacagtgttgattcgttatctgaggtagaacaaagcaaatttggagattacctttatccttttaccatctacatgaaggaggaacaaagaaaaggcagttttgctgagggagaaaatctatccaagtgatccacccatgttaaagtgttttttattttggcatttgcctgacagggtctgaagcttgcctgccactttcccattcacgtttcttagaattagaatttatatggagcctatgtctactttcatacaatatatgaaaacacttaagttatcatttaaggtaaaaactattgattaaaatatgtttatcctcttatcttgataatgatgtgatggccaggtttatatttagaattttgtgctgcctggagttccacatttgaatgtggagctgtagggacagctccaacctggcctttaagctttcctcccctgatcaaccacccactccctttcttttcttttttttatcaatctacagcatttggactcaacattttgcaagtaagcatatcttagggatttgtgacaatcttttcagcaatagtagctcattagagtggcaatgctaaatgctgcctgtgggtggttagggcaacagaaggcatacctccccaaaatgacatattataatctccagggagacgtgtgaaatttgaaaaagcttccaagatgattgcctagttaccattttgggatttgaaatctttatatacgttatttccatgccctccttggttaagtctccagatggagtaattatttacaaatgtcaataatatttacttcaaatcttactatattaacaaaaatcataggcaacgttaaagcctcttgaacaaattctttcttccttatataaatcttgtgagtctccatcctggacaagtacttgtatatttttttcacatgtggggctgacactcagctgatatacaccacaaaaacttatttgttaaacaacattatgctttataaatctaaccatttagaaatgatacatgtatatcaagtttattatttttgaatattttattccagacacccaatcaaaaagaaatataaatttgaggttgggcgtggtggctcacgcctttaatcccagcactttgggaggctgaggcaggtggatcacttgatgtcaggggttcaagaccagcctgaccaacatgttgaaaccctgtctctactaaaaatgcaaaaattagccaggcgtggtggtgcacatctttaatcccagctacttgggaggctgaagcaggagaactgcatgaacccaggaggcggaggttgcagtgagctgagatcgcaccactgcactccagcctgggtgacagagtaagactccatctcaaaaaaaaaaaataaaataaaataaatatatatatatatatatatgtatatatatttgatatattaaaaaataaactatattaagaaaaacaaaatgaatacttttgtactcaatttcatcatataattatttgcatattaacttgagggtctttttataaagtaaaacaacagaaacaacgaagagctttttgaaaatttcccttttgttgcattccttctcgaggtagcaattatattaaattcaacatttcacagtgtatggatttttttctaatgccaccactggctggttttgagatttttctcattacccttgatatttttcaatttcattttaaagtacctagttgtgggctgagatttttctttttctttcttttttgagacagggtcttgctctctttcccaggctggagtgtagtggcacaaacaacctgggcaacagagccagacttcaacctcagcctcccagctcaagcaaccctcctgcctcaggaggcaagaagctggtacctcccaagaagctggtaccactgatgtctgccatcactcctggttaattgtttgtttttgtttttgtagagacagggacttactctgttgcccaggctgctctcaaactcctggcctcaggtgatcctcctgcctccacctcccaaagtgctgggattacaggtgtgagccactgttcccaggcctgatttattttattttaaaattacatgttttgagccaggcatggtggctcatgcctgtaattccagcactttgggaggctgaggtgtgtggatcacctgtggtcaggagtttgagacaagcctgaccaacatggtgaaacatcatctctactaaaaaaaaaaaaaaaaaaaaaaaaaattagccaggtgtggtggcgcatgcctgtaatcccagctactcaggaggctgaggcaagagaattgcttgaacctaggaggcagaggttacagtgagccaggatcacgccactgcactccatcctgggcaacacagtagactctgtctcaaaatttaaaaaataaataaatacataagataaaattacatgtttgggtactgttagtgtgttttttgattgaagaactcatatccgtttttaatcttacgaatactctgctatttttttcaaatattgctcatctgctattttttccgtttatttttgtgggattactgtgaagcatatgctatatcctctccttctgtcctaagtgttttgtatgatatatccctttgtccctctgactatggttataggtgagtttcccaggaccatttttctcttttcttttttctttccaacatgtattttaggtgcaggaggtacaggtgcagatttgttacatgagtaaattatgtgttgtgggagtttggtgtacagattactttgtcacccaagtaataagcatagtacccaataggtggttttgtgatcctcactctcctctcacttgccatcctcaagtaggccctggtgtctgtggctcccttctttgtgtccatgtgtattcaatgtttcactcccggtaccacctttcgatttacaaatttgtttttaaattgtatccagttatgatcatcccatctgatgcactttttaatttatattacaattacttaatactatatgtatactttttatttctatgatttgtttatgattctttttcataagacaagaaagttgctttggttgtttttgttttaaattaatattgaattcatcttattgagcactttaaacatcttccaaaatgtttgtcaatactagagttttattgacttttataagatacattttcttcctgtgtttgaaacatttgattccagtctcatttgatgagagtatattttatatttttctccttctgtctctctccctgcttacttttcttggtgctcatatatctttgtattgctgttggcaattgcctctcgtaacccctgagcagccactttataactgggttttatacggtagtgattctggggagggcagatcccttcccagaaccagcagaagtctgtcctcaactcatgaagtccccctccatgtcctctcttctccctatacctttaggttatttagagcggctctgtccaatcaggcagccactagccattgatgaatatgtaagttgaatatttagtcaacggaattaaataaaatgtaaaatgcagttttctattcacactagccaattgtgtctaatggctaccaggaagggcagctctcatgcatcttgacagacagttctatcggatggtgtgactctagagctataatcccaggtgtcgtttctttcttgttgttgttgttttttgtttgttccagcagctggtttttttttgtttttgttttttgtttgtttgtttgtttgtttttgagatggactctttctctgtcaccaggctggagtgctgtggcgcgatcttggctcactgcaacctcggcttcctgggttcaagcgattctcctgtctcagcctcctgagtagctgggactacaagtgtgcgccaccatccccagctgatttttgtatgttagtagagacggggtttaaccatgttgaccaggatggtctggatctcttgacctcatgatccccccgcctcggcctcccaaagtgctggaaccagcggctgtttaagcttggcttgttttctttgggatggatgagccacataccatgtcccactagttgcaagcagaaagccttactttatttccctgtttcattgaatcactttcagccctctgtttcttgcaggtcctaaataaagtccaagttcccattgtctgggtccagggcttttaaatccatggtaacaaaataactcactgctttgtttttctgttccttttctggtcttcaaatcagaagctgctgttatagttttcctttatattttaaccattgtaaataattatttggacccaagagattgctgaagaattgtgcatcttggccaagaagtaaatagtccattcacttttattgcagacttatattccattatattttgaacaacctatatttatttacacatactgattttatggccattttggctgcttccaatttttacaattaataagaatgctgccattaacatcttgcacttctgcacaagtatgcaagttcctttgttggacatatagcaagaaatggagctgccagatcataggatatgtgcacactaatcattgttttatattattcttcagaattgttgcagtgtttaatcactattcctcagtatttctcaagattaagaattgatttctggctgggctcagtggctcacacatgtaatcacagcactttgggaggccaaggcaggtgaatcctctcaggtcgggagttcgagactagcctgcccaacatggtaaaaccaagtctctaccaaaattacaaaaattagccaggcgtggtggcgcatgcctgtaatcccagctacttgggaggctgaggcaggagaattgcttgaacctaggaggaggaggttgcagtgagccgagatcgcacgactgcactccagcctgggcgacaagagcaagactccatctcaaaaaaaaaaaaaaaaaaaaaaaagaatttatttctgcaaatggtggatgtagaatgctatctgattttaatttcatttattcaattattagctcatatctttttcattttttatttttattttattttattttatttttattttatgacacaaatgggtcatttgtgtttcttccttggctgtttacctgttaatggcctttgcttatgatttttttactggtttttacaagttatacattcataaaagtaaaaacattttgtttatatgatttgcaatgatctttttactgccttgggctttcttttgaacttcggtgacttttgtttagaagtgttttgtgtttttattgagaagtcaaatacattatttacttatgttgctatgtttcacaggctgctctctaattattggcctcaattgatcctcttgcctcagtctcccaagttggtgggattacagtcctgagctattttgctcagcagattgattaattgattaattaattagagacagggtctcactctgtcacccaggctagaatgtggtcaccttatcatagctcactgcagcctcaaacttctgggctcaagtgatcttcctgccttagcctcctgagtagctaggactacaagtgtgtgcaaccatgtctggctattttattttttatttttatttttttagagatggagccctgccatgttgcccaggctggtctcaaattcctggcctcaagttttcctctcacctttgcctcctaaagtgctgggagtacatgcatgagccactatgcctggccatatttattcttaaataagaatgtttctgatttgtgtgttattcaatgtattattctctagcttaaatttttaaaaatatattcctcctatgtttaagttgtgtttttcatatttaagtatgtaatatatctggatttatctgtgtgtttgtgtgtgtgtgtgtgtgtgtgtgtgtgtgtgtgagatggtgcataatttaattatttggtccatatttatgattggtggtcctatgatcctttgtgtatgggttttcctttcccctctgacttcttccaatgctacttaagtattatactaattcccacatatgacgatttgatttcctctgttctctactattggtctgtttatcatatgatcaattttacaccatctttactgccattctttatgtcttatagggaaaatcctcttggatccccattgtgtatgtctgtaaagttttatttactttcacagcactctcatacttttgtattctaacttgtttttggatcacacacacctgcagacacatagacacacacatggaaattgcatttaatttgtaaataaatttgaaataaatgacattttacaatgcttttctttctattcaagaaaatgatatgcctccatatttctccatttatagaaatcttcttttagagctccttcatgaaattttataattctctccaaaagaatcctttgcaccattagttagtttcatttcacagtagttgtaactttggttgccattttgaatgggatttttaaaaaatattttcttctaaatatatgttattggaatagaggaaaaatagggattttatatattctataaagcaagattaataaagttcactattaaagagttttttaaaagattatactaaggttaaaaaataacaaaccatatctttcattattctgctggctaaaaatcaccaattaactgtctaattgaagtattgggagcagtatccttgatttgtttccgacgtgaaagggaaagcttgaaatattttcacattatgtaatagttacatagggctgtgaatctcaaaccttcgggtgcatcagaaacacgtggagggcttggttagcaaaaggttatgattctccatggccaacgcttccgaaggagtaaatctgagctgggtgcagataatttgtattccataacaagttctcaggagacgctgctgctggggatcagaaaagaaatgtggtgaagtgggcagagaggctggatgctcgcaatgggagtcagatggcaaagttaaagatgctggtcagggcagggctcactggagcctaagttgtcacctgagcaaggtcttgaggacatgagagcattaggcatgaagattcctggaggaggagcttcttaggcacgtggaacatgagaatattactgatgtgtctgagaaacttcaagagggccatagtggctggagtagtgtggttgataaagaattataaaagagtaatcccagcattttggaaggccaagacagacggatcagttgaggtcaggagtttatgaccaccccagccagcatgatgaaacttcatttctactaaaaatacaaaaattagccaggcatggtggcagatgcctataatcctagctactcgggaggctgaggcaggagaatcacttgaatcggggaggtggaggttgcagtgagccaagatcgtgccactgcattccagcctgggtgacagaatgagacttcatctcaaaaaaaaaaaaaaaaaaaaaaaaaaaatcataaaagacaggcaagagggctaatgggaggccaggaggactaccttaaaggatcatcgtaagcactctgtcttccattttaaatgacttggggatttgctctcaagagtaagataatttgatatgtttttaaaggatcatctgacttttaagagtaagcattaaagggccaggatagaaacatggagaccaagaaaggggttgttgcagtaatacagacaagatttgttgtcatggtggggagaagtgatcagatttcagtatggttaaaggtagaccttgaacttgactctcctaccattggataagggatgtgaaataaagaaaggagtcatggatgcttttggcctgagcaactcaaaaaagattgaaccccttcaaggaaactgagggtttcccttaaatgaggacactgcgtaaagaaaggaaactgttctcctaatgcactgggtgtggaaagtgctgaggatattccaaataatacaaatacagaggatttatcaagtgcatacatgggacttggtattttttatgaaagatttatttaaggactagggaccactgtggacctccttgtgaaaaacataaattgtattttgatatcgtctaatgttaaacccaagtttcttcacaatgctacctctctccctcaattatggaaacctatatgaccacactgaagtttgccatggattcaatttgtttattattctacctcttgattcttgctgccacaaaacagtagtcatttcaactctcatcattttttcctgaagatgtggatggatgccctgctgtcccagagacagacctgaaggagccgccatggttgtcatggtatgctgaatgtacaccatagggctcagtttccctgaggaattaaagtcattccatagtaatatgtatcacctttaacttatgataacaatccagtccagttaatttcatttactttttcattgacagttaaaatgatatgtattactatgtacaatctgatgttttgacatatacatgcaatatgctgtgactaaatctacataattaacatatgtatttcttcatgtagttatcatgttggtgctgagaacactttatatccactctcttaggatttatcaagaatacaatatattaactatactcaccatgttaaaaaaaaatgtggatggatgctccctcaacaaactgaactttcctttccacagtaagatgcctgctgtgagcagctgcagaaagcagctctgtttcagcaacaaagaaaagcatattgcagaactacccatacctcatgcttccgtgtcattttcctttgcatttatttttattattcctcaaaaaacagaaacaatgttttctgcttctgatgatcaaatatttatcttctataaacttgtactttatgcttttcagtttaactacaattacctttggttttccctgggtataaaatggatgataccttaatttaaaaatgaagttttcacacaagataagaaaattgcaaattctaaataaggattgatgtctgttgctaatagtctaacaagaaaaacatagtggtatatcagaggaaatatttttttaattagcaatgtatatagttctcatttaatgactaacttttaactatgtttgaatgaatttttccttgcccacctcatcagtggcacaccgccatgacacagagaaaagtccacatctattgattattaaaaagaaggtagtgaaaaatctattaactatgttttatattatttctgtgtattcttaaacacaaaaatgaaaaataaaaatcactccttttactacaaatgcttaatctttattttctaaataataaataggctagagatgttcatttcctatttccacccaccatcatcagcactatttagtttttaaatagactaaattttttttagtcaatctcaagaaaaaaagagtttaaagtcttgggtgtggctgggcgtggtggctcatacctgtaatcccagcaatttgggagactgcagtaggtggatcgcttgaggccaggagttcgagaccagcctgagcaacatggcaaaaccccatcgctaccaaaaaatacaaaacaattagccagctgtgatggcacacgcctgtagtcccaaccgctttggaggctgaggcacgtgagtcccttgaacccggaggcagaggttgcagtgagctgagatctcgccactgcactccaacctgggtgacaaagtcttggatgtgaatctcaactactttcagtggtgtctctgacaagttgtcatccctcctctgctggagtcctacagtgacagcaattgcactttattctagaacggtacattttattttgtggtttctatgattttcaaatacatatttacattctttgaacatcagtttctttaataaataggaaccaaaatgaaaatgttatagtgatgagacataaggtaatatatataaaatgtgtatcagtgctatcaggattgcaaatattctgtaaatattagttattattttaaacgaatttgtgtcaaatctttgccttgaagtgatacagtgtcactggaaggttaagatatgaacatactttgttagttcaaagtatcatagaccagtgtcttataaacaacagatttttttctcacagttctggaggctggaggttgaatttcaggtcaccatcatggttgtacctgttgaggggcctcctccaggctgcagactaccaacttctccttgtatcctcacatggcaaaaagacagggggctagctctctagcctcttcttataagtggataaatcacatttatgagggccctgtcctggtgacctaattgccttccaaaggccacacctccaaataccatcacactgaaaaatagagtttcaacatataaactttggaagaagacaaacattcattccataatacacacagaaaatgaacttgagattattttgatataaatgcgattctgtagaaataattttaaaaacccgagtgattgacagaataattaattatatagaaaacaacgacacgaagacctaaaggtatgtagagaatattttcagttttaatattcaggtaagttttttaattgggttgggttaagcatatacatatgtatacacacgtataacatacacatatctcatctatatagacacttccccgtgaacctagttgttttgcccccacacccaatccccacccactcacatatctaaatgtatctctgaatgcagatctgttaaggcaggtgggaaccttagagtgaatatagatcacttgtagccttctccacaaagcattagcactgagactcagcgtgcacacatttctacatggcaggtggccccatcgaggtcctgttaaaaagggtgcagatatagaggatgtacggtgccctgctgataagaactaaacagtgacccctgataaattaacgtttctttgtccaaaccaaaatgaggccctgactcatttcaggagaggcacttataattattgaggaaaggtgttaggaagaaatcacaggccctagagactctcaacaatctgtatcaataaagtctaataacatcataggaagcaaattaaggtggaaactgattgctgctgattgcaaaggtctttatacataatttaaatgatccataaagagcaactggtggactagtctccaaaataaattatcctgtaacaggaaattcaaatgttttgatcactagaatacaaatgataaaattacataatatgaaaacataattttaatatacattttactgaggaaagtggtttctatttaatcagtgaaaataagtttattaatatggaattgtatagtctttcattggaactagttatttactagttcttttattggttaatgtgagctaaacatcaaaccaaattctgtaccacttattcccaaagacaccgaatgatagagtggcagtaatcaaaataaagaaaaaaatacaataccttaaagatgtaggtgcattgaaattaagtaagctttacatctagaaacaattttggtctatctgaggcttgattctgagccctgagcttgtattatataaataattttttatagtgaaaagtgatcatgactttggaatactatgtaagcaatgttttgggcattatctgtttctctagtgggtccatccatccaggttcattggtttgcagaaaatatataaaatgaagcattggaaaagctttttttttttttttttttttttttttgagatggagtcttgctgtgtcgcccaggctagagtgcagtggcttgatcttggctcactgcaagctctgcctcccaggttcacgccatcctcctgcctcagcctcccaagtagctgggactacaggcacccgccaccacgcttggttaattttttgtatttttagtagagacagggtttcaccacgttagtagtagatcggggtcttgatctcctgacctcgtgatccgcctgcctcgacctcccaaagtgctgggattacaggcgtgagccaccacctgtggccggaaaagctttcacataatctccaagcacagcaggttttaagtaatctgagtgtacaggaatctctcaaccaaggggttcttgggcttctactgtaacactcccagtggcagagaccattgtgtttctgtatggttctattgaaaagtctttttttttttttaatagtgagccaatgtctctgtccttccatttccactcacctgtatgtcaaagcctcacaaaacaagcccaaactcagtgtcccaagacagctatcagctgtgggataataaccaccacaccctcttcccgaaaaggagactgactccagttattctattcactaacatattcctctgagtaattcattttcaatgtctctgttaaaggaagacatttaaaaaaataaaaataaagaggacgagatccacatatactagtctgctagctcctatctggtacacccactggctttaccctaatttcttcaactcaaatatctccctttctcccttcagcctaggagtgagatggtttcattctgttgtcaactcctgttttactttatcatcccttgcttagcttctgactctttcttcacctgtgcaatcaattgtctttattaaaagatacttgaagaggtttctgttgtggtttccgtataccaagaacacgatgatcatatttgtgattctgattacctattctttgaggttcaatgtctacttcttgtttaaagcaactgttagtattgacattaaaagttctactatataaattgacatctgtggacaaaagaaaagtgatttaaaagtttttcaatttttgacaatgaaaactcatggtcaaaaaggcctagacacaagtcacaactgcaaaccttatttgctttgcaacttgctcaaattattccaaatctccattttccatatttaaaataacaaaacaatgctgacttaacaacacagggtggaatatgtaggtaattatgtcaagtgtctagcacagaatctggaaaattgtaggcacttgataaacatgacttctgccgtttctacataaaatgatgtagattaattccaagagccccagtcacttcttatttacttctgacaaatgatttttttctaaagtactaattataaaattgactaatgatgttgtagcctagggaagttttagagtaggtcattaaagttgtaattgtagtgcaaatttttttagatcgaggtctggtaataaatcccccagaaacctttatataatgtagctttctttatttaaaaccaaggcacagaatgaaaaaactagagctttgtatcttcaaaaacgtttatgagctttataagtaatgagtaggcatggctctcttttgtgcaccagaccagggccattagaggaaatgagtgcccagaggggataaatcactctccccaaagtgcagtgaggaagtagtgaatgggagtgtgtatacctgtgcacatgcagttgtgtgagagtgagagtgtttgtggtggaggtgtgtgtattggaagtaatagtgtagattccaaaagaagatggatgcagaggtttgctattctagttttgataaatttaagacctctattatgtggaatgattaggggaaaaaccttttgctgttagtgttacaaaaacatgcatgagtgtttatgttctatagataaagatacataccttaatgtatgctatatagaatatatggtcaagccagctgatctgtaaacctgtgtgctcttagatccatgtcctggcccttcttctattctgttccctatttcagagcaccacatttcttaggctctcttgaccaacggctttgaggggagttggccagtaggaagcactaaatgtgaaggctctctatctttctgttttgtctgtttttctggttcacttccaacagcagctaggttcatctagggtttcagctcctgtctgatagacccattggttttactttagtctctgtgactcagacgtctccctttctcccttcagcctagggatgagaatggcttcatgctgttgccagtccctgttactttatcatcccctgcttagcttcttgccacttcttcagctgtgtagtcaattgcctttattaaattttctcatttcagatacttaaagaggtttctgttttctgggtataccaactcttgctttctcagtatatttaatattgagtgagcatatgaattgagagattaggatattagtacatattaaatctaaatctatattaaatatcactgtaattttcctttagacattttcagattgacttaactgtgccattaagtgactgtgggaaatcattaaactcgtggtcttactttaacctttatctgtacaataagtctaaaatgataggcttgacttacctcaaaagatagttaaggctgggcacagtggctcatgcctgtaatcctagcacttcgggaggccgaggtgggctgatcacctgaggtcaggggttcaagaccagcctggccaacatggcaaaaccccatctctactaaaaatacaaaaattagttgggtgtggtggcgcattcctgtaatctcagctacttgggaggctgaggcaggagaatcccttgaacccgggaggcagaggttgcagtgagctgagattgcgccactgcactccagcctgggtgactggtctcaaaaaaaaaacaaaactaacaaattaataataaaatggagcacttgagaaatatgcataacactgtgtaagtgctcaagagcaacaagagaaagagaaataaacataagtctccattgttggtttaatgttgaaatcaaatctaagctttaacatatgcttttcatgtgccctagaacaccgaggttgattcaacttcaatctctaaacctacaaaatagtggtaacaacatctccttctcaacagtgtcatgagggttactttacctaacctttgtaatgctctcagcacatggggattgcatagaatgggtcttcaaggaggttggttctttcttcatctattcctcagcaagatgtagaagttctttctgatagcactccctggtcaatttattcctaagtaaaacacatatataggagtattttatacatatatatatatatatatatatatatatatatcacccatcacttgattaactgaatctctctctctcttttagcagaaactaatcaccatgtatttattgagttcaagtcactgctcatctctgagattccatttcaacttgtcaaacactccagttaaatagtattcctctgaatttcactttgaatttactgtatatggatatctatttaatttttgccaacttacttgttccaggttgcattttgcttttttatttttatttatttgtttttgtttgtttgtttatttattttgaaacagagtttcacccttttttttttttttttttttttttttgagatggagtctccctctgtcacccaggctggagtgcagtagcgtgatctccgctcactgcaagctccacctcccaggttcacgccattcgtctgcctcagcctcccgagtagctgggactacaggtgccctccaccatgcccggctaattttttgtattttttttttttagtagaggcggtgtttcactatggtagccaggattgtctcgatcttctgacctcgtgatccgcctgcttcggcctcccaaaatgctgggattacaggcgtgagccaccgcgcccggccttgaaacagagtttcactcttgtcgcccaggctggagtgcaatggcacgatcttggctcactgcaacctccacctcccgggttctgtcaattctcctgcctcagcctttcgagtagctaggattacaggcaccctccgccacacctggctaatttttgtatttttagcagaggcgtggtttcacggtgttggtcaggctcgtctggaactcctgacctcaggtgatctgcccatctcagcctcccaaaatgctgggattacaggcgtgagctaccacacccagttcttatttgttttaataaaaggtcaacaattttatgcatatcactatttgagagaatatcccctacgttgccttctgtagcttacctatccttacacatgtgtttgtgtaatttgcccagtttccacatgacattcagatttagaatggtatgtctcattatgcaatcttgcccaagctagtgactttgatattgccacctctttttgaccttgctttgttacaagaaaaaaaaaaaaaaaatgggaggggacatgttacccaaactctagccagttgaattgtgctgactgctttccaaaagaacatatgttctcactggaaagattcagaaaaatttggcatcagggatggcatgtggaatttaggaataagtctttgctttttaagaggaagtatgaaatagaagaaagtacattgaatttagaaacagaacatgtggggcctggttgttgttcgaccccttatgccctttgatgtcttaggtaagtccctcatctttgttgaaacatgctctttattatttcttctatctccacaattccatggtattagaaaatgtttatatttgagacaaaacctgcacttgcatctatctgctttaatttgaatattatatttttgtgtctaagatacgctataatattgagcgattcttggtattgaaaatcaaaggaagatgagacattataaatgggtcatagtcaacaaagcaaagaatgtgcaacatttattaaaactatttgatccatcttatattgcatcatcattaagtgtattttttagttttaaaaatgcaaaaaaatatagatgtggtcataatgaaaagcaatcagttatggacctatttttctgctccaagcccccacccctaatctcctcattcacaccctgagctcaacacacacaggatagcttattaaatcacttcacttggggtttttctggttgttaatttcacatatataaatagcacactaagcctctatttcttgctttatctactttagatatggagcattgattttctactgataatgagaatgaaagtcatttactccgcaccccacttcttctgtctcctccctgactttatcattattctcagtttccaaagttggtcttcatgacacacctaattgaggataatagtatagttaagaaacagggcttactgtggaaagcagtttggagatttctcaaaggacttaaaactactgttcaacccacccgtcccactactagtatatatatatatttaagagaaaataaattgttctaccaaaagacccatgcacttgcatgtttatcacagcactattcacaacagcaaagacgtggaatcaacctaggtgctgatcaacagtggattggataagaaaaatgaggtaatatacatcatggaatactacacagccataaaaagaataaaattacatctttcacaaaacatggatgcagctagaggccattatcctaagcaaattagtataaaaacagaaaaacaaatattgcatgctctcacccatgaaaactgaacaatgggtttacatggacataaaaatggcaacaatagacactggggactactggagaggggaaggatggagaggggcaagggttgaaaaactaactattggatactatgcttcgtacctgggtaatggggtcgattgaaccccagaatctcagcatcatgcaaaatacccatgttacaaacgtgcatatgtacaccctgaatctaaaataaaagtttaaattatgagaaaacaaacagaaaatatatttgaaaaatatttgtatcattaacgtaaattcatgttgaaatgataaaacattttgccaataaaagtaattttaacttggaaaaaaaaatagaatgatagtctataaatgtgtgataattcctgaagcctttggaaaatacgataaattttaaaaataagatttaatgatttgtctttaaaaacataaatagtccaggcgtggtggctcacgcctgtaatcccagcactttgggaggccgaggtgggcagatcacttcaggtcaggagttcgagaccaaactggccaacatggtgaaaccccatctctaccaaaaatacaaaaattagccaggcatggtggcacacacctgtaatcccagctacttgggaggttgagacaggagaatcacttgaacctgggaggtggaggttgcagagagctgagatcacgccactgcactccagcctgggcgacagagcgagactccatctcaaaaaaaagtaaataaataaaaaaaatttaaaaaataaaagcataaatgaatgaattgatgaataagtaaatagcttagcttcagaaaaaaaaagaaaaaaaaacaagaaacaggaatttttgtataaaattaagattgctctagttatataattccctggttttcccccaacaaattttcaaacttacaataacaattatatttgactgagtgccaatttaaacctataggcctatgctactttttttttttttaagaccagacctccctttcatctcagtctgaggtacatgaggcttttaatatgaaatcactttccattcggtccaaagcttccttgttgctgatgaatgtcatacataatgaaagattatatccatttatcctcagcagtaaatcatttatcacacaagggggatatattattgtgaattctgatcaaagctgcccacttcctttagccggcagaaatgctgcaccctgttagttgattgtacaatatcctgggagaaatagggaaaattatgctgttgaatgagggtttggcaactctaggggtttctaaaatgccttgtagaaaaatcatgtttcatgtagaaccttctatgattcaggcatgtgagctgtaaaagtcttattttgccttcttcgcttaattaaatcagaaggctgtgggacttttttcagcttgctctgtgatgtctgcaaacagattcctgaatgacatcctgtggacactttgcccccttttttagagagacaataattattaccacttctttttgaagcatgctgagtggttttatcagttgtttgctaatgagctctgtctctcctttataatgtcaatcataaggatgccttttaaatacaacttatctcccagatttattttcttttcattcttcctgatcaaggtacgtactgttttgcttcagggaatcatctacacaacccaggcagagaaggctggcctctttgatctcttgtggataacacactctctccttctgagaacagagctttccaaaaaggacattaccaccctccagatgagtctcttcttgtgttttatctgtgattttaggttatcattgccctctgttacacgtctgtattcactgcttttcaaattcaatagcatgtaagagtctcagtattaaaattatcctgagtcaagtgagatacagaatgaagcaggaacaataggtcttttcttccttccttctctcttgggcttctggccagcatgctggtatggtttgttcagattttatgcaaagctttacctggcgattcaccaaatcaagtcagaaacctgcacctaacatttataaacaacatttcttcatttgatcatcaccttattcttgaagtagctttcagtgctttggctatttaagaagtcagtattgaaattcatattctacccttgcacactgtgtgagctcactatatcccttgtgtggtgtatagaggaagtataattttccccaagtgccttatccttaaaacaagagatagctaaattgatcagaacgggatatcgttataggaaaaattgtatacattaaactttaggtgtttctgttaatagttcctactactgtgactattcagattattgtattccaacataggtaaaattgatggatttagcaaataaaatacagtacacctgttcacatctgaatttcagataaacaatgaatgcatttttagtataagtatgtcccaaatattgcttctaggacacatacaagaaattgttgtttatctgaaattcagatttgaacaggtgtactgtattttacctggcaacactacatatagtagaattcacgttctagtctttgctagtctgtagatattacgttcccctacttggtaactcctgtgaactgaattgtactgcccctacactgctattcacacggtgaagccctaactcccaatgagactgtatttggagataggatctttaggggaaaattaaggttaaatgaggtcacaaggatggggccttaatcctgtagcactgtgggcttataaaaagagagaatctctcttaggtgaggactcagcaagaaggtggggtctgcaacccaaggagagagccctcatcaaaacccaataatgctgcacctgaatcttggactcctagtctccagaaatttgggaaaataaatatctgttgcctaagccacctggtctatggtattttgttacagcagcccaacctgatttatacagtaactttaggatgtcttactagggcacagttttatgtttcttgctgaactgagatctagcaagcatagtcattaccttagatatggtatggctgtgtccccacccaaatcttatcttgaattataacttccataattcccatgtcatgggagggacccagtgggaggtaattgaatcatgggggcgagtctttcccgtgcggttctcatggtaatgaatgggtctcacaagatctgatggttttataaatgggagttgccctgccctgcacaagctctctttttgcctgctgccattcatgtaagatgtgacttgctcctccttgccttctgccatgattgggagcctccccagccatgtggaactgtaagtccattaaacctcttttgtaaattgcccagtctcgggtatgtctttatcagcagagtgaaaatggactaatacattaaatttgttaccagtagagcgggaccctgctgaaaagataactgaaaatttggaaataactttggaactgggtaacaagcagaggttggaacagtttggagggctcagaactagaaaggaaaacacaggaaagtttggaacttcctagagacttgttgaatggctttgacaaaaatgctgatagtgatatgaacaataagttccaggctgaggtggtctcagatgaagatgagaaacttgttgggaactagagcaaagctgcctcttgttatgttttacaaagagactggtggcatttttccccttccctagatatttgtgcaactttgaacttgagagagataatgtagggtatctggtggaagaaatttccaagcagcaaagcattcaagaggtgacttgggtgctgttaaaggcattcagttttataagggaagcagagcataaaagttcagaaaatttgcagcctgacaatgtgatagaaaagaaaattcaattttctgaggagaaattcaagctggctgcagaaatttgcataagtaacaaggagccgaatgttaatccccaagacaatggggaaaatgtctccaaggtatgtcggagatcttcacggcagcccctcccatcacaggcctggaggcctaggagaaaaaaaaatggttttgtgggccaggcctagggcccctctgctatgtgcagtctagggacttggtgccctgcatcccagctgctccagccatgactaaaaggggccaaggtacagctcaggccatggcttcagagggtgcaagcaccaagccttggcttccatgtggtgttgagcctgcaggtacacaaaagtcaagaattgaggtttggaaacctctgcctagatttcagaggatgtatgcaaatgcctggatgtctgggcagaagtttgctgcaggggcaggatgctcatggagaacctctgctagggcagtgcagaagggaaatgtggggttgaggccttcacacagagtccctactggggcactgtctagtggagctgtgagaagagagccactgtcctccagaccccagaatggtagatccaccaattgcttgcactgtgcacctgaaaaagctgcagacactcaatggcagcccaagaaaacagctgggagggatgctgtactctgcaaaaccacagagatggagctgcccaagaccataggaacccacctctcacatcattgtgacccagatgagagacatggtgtcaaaggagatcattttggagctttaagatttgactgccctgctggattttggacttgcatgggacctgtagccccttcattttggccaatttctcccatttgaaacaactgtatttacccaatgcctgtgcccccagtgtatctaggaagtaactaatttggttttgattttacaggctcataggcagaaggtacttgcctcgtctcagatgagacgttggactgtggacttttgagttaatgctgaaatgagttaagactttgggggactgtagggaacgcatgatttgttttggttttgaaatgtgaggtcatgagatttcagagaggtcggggtggaataatatggtttggctgtgtccccacccaaatcccatcttgaattgtaactcctgcaattcccacatgtcatgggagggagccaatgggaggtaattgaatcgtggggtctggtctttcctatgctgttctcatgatactaaatgggtctcacaagatccgatggtttaaaaatgggagttgccctgcacaagctctctttttacctgctaccatccatgtaagatgcgacttgttcctccttgccttctgccatgattgtgagatctcctcagccatgtggaactgtaagtccattaaacctctttcttttgtaaatttcccagtcttgggtatgtctttatcagcagggtgaaaacagactaatacaacctttctagtctggacatgttagtcaattactcttctgattctgagcaagtagagacaactgaaggaatctcccaatggttgtcccttaaacgtcaaattctatgattggctaatttctcaattttgatcatatcataaatcagaacaataaagagaaatcatggggggtagatgtgacaatgaacccagcctactattggctgaaaaatattaaaggcactgatgggaacatttaattgagtagacaaatgggggagatagcctgactgtcctctgactttgctgttagcatctaaatctacctaaattattggatgtatttacaaggaataagggcagtgtttgtttgtgtgtgtgtgtgagggtgtgagtgtgtgtaaaggtacacagagcatgtactaaatcaagattcagtaaccccatttagaaaggagcacctgagacttctgagaggttaatcacaggcctccatcacccttctaagtggcagaattggagaccatcctgcagccaaagacatgccttttcctccataactgactacctacattgaaaactagaatctcacatttttcacaatagatcttttgtatactaagaaatcagtaacagtgcatttcctcaaattgacatgaagcaaaatttcatccatcttccaacaacctgtcattgttaccccctctaaaccttttcttcttcataagggcaattattattttattacctctggtatgatattaaaattatgaagactttcctccaaggggccaccatattactgtctcatttacattcttatactaaaaatagatttttttttataccagatgtggtaaaatcaaagctaagttagacagaatgggtgattcctcccacatagctgctctggagaacatcgctatgcaccctgaagtgtacagggtgttcatgcccatgttaggtattttagttttgttaatgaggtggtgaggttgaggtgaagctcatgactaagtagaggcagaaatctctataaagaccaaatgtttattcagactgatgtgagaactctttagcttctgattctccaagaacaaatgtgtcataattagaagtaaaaaattgatgtgaatgggttgctgtttcccaggtactaaaagtgaccaatgaagtgtacggctagctgctggacacaagtccctgatactcaaggcctggttgagaagaccttgtagttgagcaaactcatttgttattatattttttaactcatcaaacttgaacttgttctttttcttttccttttttgtggctcaaatagtgatgcatgcagcacaacacctggatttgggcaaatgattttaaattcacacgtaaaaaccatagcaattttatgatgaattggcctccatctacttctgaatttaaactttgctaaagggaaaatccctacattttcttttctttttttttttcctttttttttttttttgagacggagtctcgctctgtcacccaggctggagcgcagggggtcgatctcggccaatgcaagctctgcctcccaggttccagccattctcctgcctcagcctcccaggtagctgagactacaggtgcccaccaccgtgcctggctaattttttgtatttttagtagagacagggtttaactgtgttagccaggatggtctcgatctcctgaccttgtgatccacccgcctcagcctcccaaagttctgggattacaggtgtgagctaccgtgcctggccaatccctacattttcttaaaatttaagatataattccattagcaagaaacgtcagagtgacattttaagcaatgcttgcatcagacaaaaaatgtatgatgtatttgaaatctattgacaacacattggaaaaccttcaagagttctaaagcagccgttactctgaaatttaaaataatcccattttagattctttcaattatagttaagaggattttgtaaaggctgtacctgtagccagtctgtaggtaattttaataacaagtggttaacttaaagatcttcctgtgttaattagtgttcttttttaaataagaattattaattaaattctcaattcagcaaaagaaaccttattctttaatcaatgtcacaaaattctccatagtcaaacttagatctcagtttccgtgatgagtggctggggaaaggaatgcgttctcccaccattaataccttttgagccaataactctaggctgtagatccttagctagaaacgtttttgtccacccagaacacactttgcatttagactgaggcctcctttgaaattctggctcctacatttcctatctccttgacactgggcaattcagttttccttgctgagaatccatcctctgttttttgtttgttcattttggttttggttttggcttttaaatcgagggtagtctgcagtcaagaaatatcactggaagctgggtgcggtggctcacgtctgtaatcccagcactttgggaggctgaggcaggcggataacttgaggtcaggagttccagactagcctggccaacatggtgaaaccccatctctactaaaaatacaaaacttagccaggcatggtggcacatgcatgtagtcccagctactggggaggctgaggcaggagaattgcttgagcctgggaggtggaggttacagtgagccgagatcatgccactgcactccagcctgggttacagagagatactctgtctcaaaaaaaaaaaaaaaaaaaagaaaatgtcattagtctttgaccaatatttatccagtccttatccagccccagttcctagtaatcaccattctactctctgcttcagtgagttcaacttttttagattccacgtatacgtgataacgtggtatttgtctttctgtgcctggcttatttcacttaacataatgccttccagtttcattcatgttgtcacaaatgacagaatttcctttttttctctaaagctgaatagtattccattgtgtatatgtagataccatattttatttatctattcatctgttgatgaatgtttaggttgattccatttctgggctattgtgaatagtgttgatataagcgtaggaatgtaaatatctcttccacatactaattttatttcctttgtctatatatccagtagtgggactgcttaatcatatggtacttctattttaaattttctgaagaatcaccattctatgttccataatggctttactaatgacattcccaccagcagtgcacaggaggaataatttcaagaaatctactgcataatatagttatgactatagttaataacaatgtactatatacctaaaaaattgctaacagtagacattaagtgttctcaccacaaataacataaggtacaatataggttaatagcttgatttagccattccacattgaatacatatttcaaaacatcatgttttaaaacattaaaacatcatgttgtacattataaatatatataatttttatgtcataaaaaaagaaatgtcattatcattctttagtgacaattcacctgaagtcttcttacccatagttgatgagtgtcttttaaattataaagctcaggaagtatgcctttaaatcactaaccaatatctgtgatatggtttgcttaagaacatttttagattggagaataatttacaaatctaggtctttcatttttaaaataaatcatggtgttagttcatgatatttgggccatatttttaaatcctaatcctgggaaaggtggttaggtatatggcaatttatgtctccactgaatttccatacagaatgccagaaggtaccacagataaagcaagagctttaaggtcaatcacagctgagtttgtatgtagttcaagtacttactggctgtgtggttttggggtaatatacttaacctttctcaatctctgtttcttcagttgaaaagctgggattatgctttcaaattcaaataataataaaaactaacatttcttgaatgcttatcatgcaccacaggtattgtatcatttactcctaataataaatccagggggtggctactgttatctgcattttacaaataaagaaaggaggcacaaaaaggcagagcagccaggcttcaaaaccaggcagagctccagaccaccttgcctctcaaatgtaaacttgaaatgccagacgatctttccattttccccaaccaaggactgacactgaggctgaggagaattggcagaagagagagaagaatatctggagggtttgttcctttttcaaatcagcatttaatagccctgttaaattggcaggcgtgtatattactgaccatgtttctattttcctgtaacaccaaagagtaaaggccattttttttccctatgaataaaagttgtcacggtcaggaaataaaccatatagtttgtctacaaccatttcccttgtgaagctaattgattttggctagttaaaactttatgtctaaaatcaaggtccaaagaagaaagtatgtataccttctatagcatttataaagagaccaggcactatgcaggaattggagcaaacatttgaacatatttgtattcttcatatatttgtctctataaattatataaaatccatttttgtagatacagagtataagattcctaggcataaaaatgactaaaatgcaattgtatataatatcagctacctgcacttgtttttctccttcctaataccatctcatttttttggggggttgaaactgagaaacaaagatattaaataattttcctaaaatatacccatacaactaaatgggaaagccataatataaaccatccctcttaatcatcatgatattaataaggaagacaggtgctaagcaaccatatgttgactgggctatctatgtagataatcaagtccctgagaatgaggacagagtagaattggagagtgtgacagtgaagcaacaataacacctttcatcaatgagtaaatgaccaggaaatccacagatgtggagcaagagagtagcacagttctctcaatagaaccatgttagtgttgcttgtttttgtatctgtcttgttttgttttcctaacaagaggaagaaggagaaattgaagaatgatctggaaatgtaaggaggctgttgattacaactgggggttcaatttttcactcattgtcatattataagccgtaacttagttgttattcaggaaataggctgaaagacactggcagatgagaattgcagagatgggaatgctctgaagttagcagtgtggccaggtggccaggataatcacttttagctggccaaaagatgatcatttctgtgggaacatcagcaagtgagtgacctgaccattttaagtctcttccttagggtcctccacatccagcctgggtaatatgttgctcaatctgctttaccacaccaggcaaaacaagtattgaatttcaaccaatgatcacagatcttgtattgtctcatccttgctggtactgttcgcttttctctggctcaattgttgccttttaaaactctttacttaaaccagccactgggcttttccttggggacaatgtagaagaggaaaacaatgatagaagggggtgctttttatttcaggtacagctgggcaggtgggatggatcagggaaaagctccaaggatgtcaagagtagaaatagtgatgtctacctttgaaactacaaaactccctacacaaccaagtgattggagctttgaaagcaatgcggagtagaaaactaatagaatatcaacctagttaaggcaagatttgctgtggggaagggaaggtcctgagcctctatttggccctgaggcttatcaacctgatacttcagttgggctcagaaagactcctgccccctccccattccctccctcccattgtgagggaccaatctctcttattctgtgttttcttaccatctcttccaccacttacctgctctactctgctttgcacatggtctcctcaactatgcccttccctacagccttttaaatgtggaaaagaaacaaaacaaataacatgatcaagaacttaccggtttccaggccaagtgcagtggctcacacctgtaaacccaaacactttgggaggccaagacaggaggattgcttgaggccaggaatttgagaccaacttcggcaacctagcaaaacccccctctacaaaaaattaaaaaaaataactgagtatggtggtgcacaattgtagtttcagctactcaggaggctgaggctgtaggattccttgagtctaggaggtcaaggctgcagctagccactgcatgccagcctggacaacagagtaagactctgcctcaaaaaaaaaaagaaaaaaaaaagaagggaagggaagaaggaaggagggaggaaggaagaaagaaagaaagaaattcactggtttccaatgtaacaaatcctttatctcaaagtagatgtacacttagagttggagacttttttaaaaacaattacaatgtctcggctcttgtgaactgagtttgctgtatggttatgtcactgtggataatgattttctcatttttttacacaatgtttatcaactttggctgtgcttcctctcctgagcatgctccttgttttgtaaaacaactggggaacattgagatttttcatataatttctgtgatgccaggctcctaagggataaagaaatacaaagaacagtgactggacagattgagtggagctttgaaagcaatacagagtagaaagataatagaatatctactataatgacacatgcacaagtgtttttattgcaacactatttgcaatagcaaagactaggaaccaaccaaaatgcctatcaatgatagactggataaagaaaatgtggcccatatacaccatggaatactatgcagccataaaaaagaataagttcgtgtcctttgcagggacatggatgaagctagaatccatcattctcagtaagctatcacagaaacagaaaaccaaacaccacattatcactcataagtgggagttgaacaatgaaagcacatggacacagggaggggaacatcacacaccggggcctgtcagggggtgggtggctaggggagggatagcattagtacaaatacctaatgcatgtgaggtttaaaacctggatgtcgggttggtgggtgcagcaaaccaccatggcacatgtatacctatgtaacaaacctgcacattttgcacatgtatcccagaacttaaaataataaaaaaaagaaagataatagaatattaacctggttaaggcaagatttgtgttttttaaaacatatattccccattaaagactacacatgtacttcttaatgttattaactttgtcatgtattaagatgaacagaaaggcatttctattatatgaattttttcttattcttgtgtctttcaaaaagaaaaaagaaaataaaacaaacaaatacacactcaactctcccccaaaaaaccaaaacaaaaacaagcaatgcaataatatttctcaaaagatatgcttgacacactatcagaagttctgccaacttcaatctatgcactagaagtgcattgaaaacttttattctttgcttcttgtctttaatattgttgtaaattcaatccacttcactggcattacctgctagcaacattccatcttcacatttggatgagtgtgaacttatcaaggtgacatatgtgtgatttttaatggaaattttactttgtttttcttaaaactgggtgtcaattagcagtgactcgcctccttaacaaaggaacagggtttgctgcctgcccagccacacagcccctggggggcttcctagcctgggctaggctgctgcaacatcatcacactttattagttacagcacagagttatggaggcaggaggaaagtactcactatgcaattttcctgataccccatgaggcctgagcacctcaaggtgggttagcactcatggaaaatcagtttaagatgggaaaatttcaaacatctttccttattttctttcccacacacaaatagaataatgcattttaagtaacaaagaacacttaaaaagcaaaacaaaaacaaaaagacacttatccttaaaagccaccatctccttaggatattcctcttatattaaataaggatacaaagagtaaagtgtacttaaaatctctcacaaagattggaaataaaatcttcaaaaagtgaatgcatacaatagcacatacgtaggacgtaattcattattattgggaaatgaaaatgaaagcaccatggtacgataattctgaataagaacaagctaattacattagggcagctttcagaaaacaagaatttatttttttatgacaaatatgactcagtacaaagtacacaaagtattttctgactcttactgtgatatgcctactttatttcaagtaaaatatatgaatttttaaaaggttatgaaaatgtgtttatgctttaaaaaaatcatttcagtaacatgttggatatctggaatatccatatattggaggtctgtgttctcagtctacaaggaaaattgccaaatccactctagagtgccaggcttaaaaaggtgttgaagagagcctgcccgattacctgaattccaatttggctcacaatgaaagatagaaaaattacctagatgcatttcaatgttgcttctccccttgcaatagaccttatttaatagcttattacactcagaaaacaaagcatattttaaggaaagaactcacgacgcatggttcctgtctcttgacagaacggcctctttgaattcttttgtcaatttcatagatttctaacaagcagagaattgttttttaaatctgattttttttaatgccagcagcactatttcctcctcttaagtaggacagattcatcctttaagcaacaatggatgcttccctgctgaactcgagcatgacagattaagcttcgagcagaccagtaaatgccacctccccacttaacaaggctgttcagagccaggcgtctggggcctcgccgtatttgttcctggaatcactgtctgatgagccactgctgtccgaggtggccaagcagccctgattgagcgagctatgtgaagacccgacaggggcctggcagggcggcgggggcatgcctcctttttggtgcttccaggcaaattccttgcctccaaattgtgcccgcctcaggacagttggcttgtacaatgcctggcagaaagtagacactttgcacttgtttactgaatataaaagagaaaaatagagagagaaaaaatctgagtttagagatgcctttcagaccttgccggataaaatgctgttatttctggcaaagtggtgaggtgacactgacttggaagaataactaagaggttaaaaaaaaaaaagtaggactaacagtgaacaagctaataaaacacatggaaaccaaattagtggtagccaaaatcaataatagatccattatatttcaaaatatcttttataagaaaatggcacttggaatatgtttctaaatgccttttagagaccagtgtgttgcataaagaaaaatacacctgcatccagaattataattttaagaaccattatttagattgctgtgaggtatcttaaaatgcgattcaatttgctccttagatattgcatatcaaactataaaagcaaagctacattgttggctttctccctttttggcaaagaaatagaattgagaatctgcctgttgaggtcagaaacagactgaatcaaaaaatatgaaagcatgaatgtactgttctcacatttatgtaattgatggctattttacttgttgaaatcttaagtctttcacaaccacatgcgtatgtttgtcatttatccccttttctcaggtgcaaagaaggctaccaaggagtccgttgtgatcaatttctgccgaaaactgattccatcttatcggatccaagtaggtcaagcatttttcttctctctaatgcaatatataggcagcgtttattctgagcaatggttgttaactcagctgaaagctatatttcagtcttgtgtctctgaaagctgccaaggacagaagctgatggcagatgttgatgttcaaagcatcctcagagctggctcagtctaggtcttctctgacgatgaggcctggcttccggattccaccttgaacccctgctgggaactcccaacaacccgggcctccttagctttccttctgcccagccacgtaccacctcatttcaaaagcagggatctagaaaaataacagagcttattatttacctgaaataatgttatggaaactacagtattataccgcttcttacgctttggttgttaatttatgatagtattaaaccataccttactaaagtaagaaaacgtgtacgaaatcatgtaagaagttttcaagcagactttgaaaactccatttttggcaacactatttgcatatcagtgattactgtcctaaggacaaattattttttctccattcatggaagaagacaatttgcagactaaaaaatatggctagtcattagtttgtttgtatggtagtaaaagtaaccttttatgcttaaatgcccaattctagtcaaatgtgaaatgtttatctttaaagaattctctgttctttcaatagctgctagaattgaatcatgactaaaaaatggggattttcattgaatcagcgatttagtttagtgaggataatgataggcattttgcaattggaaaggccaagttatggttttctgaatatcatacatacgtaacacagacttcagtaaatattttgtactgactaaggacagaggtcgccctgcctgtgtctgtgcgttttgctgcataatgaacgtgtctaggcatcttccaacatcttttcaaaatgcatattttcatttccccctgaatttctagctacatttactcaagtaaatgcaaagttatttgaaagaaaaaggttttgtttaatttaatttaattctattttatcttgacgaagcaattcaccatacagtaactactctttctttgcaaatttagctttccttgagaaaagtgaaggttgccacagggatatctctatttcctgaaatgtgagacacagttctctgggaattacccaaagaggatggtattactggagtttttggtatcttatttatcaagtgatttggaccacttgctcaggtggcctctgaaagggtattcatggttatgatgtgagacatatctttggcatgttaggaaacttgcataaaataatgggcttgctgatttctttctttttctttctctctcttttttcctcacttttcctaatgtatctagtttttctctttttctttctctcttttttctgtttttatcccttctcttttcctatttatttcccttcattattttgtctcctttaatataatacttcttcccttcctccctctttcccttcctccctctttccctttccccctttcctcccttcctcccttcctctcttcctttcttctttctttcctttcttccttccttcctccctccctcccttctttcctgttttgctttcttttcatatgtggctgtggaatagctattcagtacaggttacaaagggcaaggtcttgcatatggtacaaagtgggtaaaaaaaacctctttaaacaatctaatcaaatgttaccagccatttagataccatagttcatcactgcaagagtggaggagggggtcaccataatgactattctctcctcgtagaacaaaatggtcccacggttacagtcactatccctgaaaacctatttcaatgtctattaaattgctattaaaattatagctgtgtgagccaggcacggtggttcatgcctataaacccagcactttgggaggcagagatgcttgaggtcaggagtttgagaccagcctggccaacatggtgaaaccctgtctctactaaaaatacaaaaattagcctggtatggtggcaagtgcctgtagtctcagctacctctggaggctgagagaggagaatcacttgaatccaggaggcaaagttgaagtgagccaagatcacgccactgtactccagcctgggtgacagagcaagactctgtctcaaaaaaaaaaaaaaaaaaaaaaaaaattatacctctctgaaatgtttctattaagtgaaactgcaagataaaaaattacttttatataaaattgcaaaaggaacatactttgccccaaatgtagaaaagaaatacactaaaatgttgtaaggacgtggaattttatgaaattgtttttctatttctccagttttctgtaaagtggtatatcattatgtgagtcaaaatgccagaatccttgaaatttaaaaagaaagaataagcatggagagcccatggatgagtccttgagacacagcttaaatggaaaagcattatgtcttgcattcatccatgcacacgtgcatttctttaggtaatcattaattcatttcatcagtattttctcagcatccaccaagagccacctaattggtcaggctctgttaatacaaaagtgtgcaaacaggatttaggccctgaggatcccgcagattagtgagggggaaaaacatgtggatatataaacatggggatgaatttggtgtaacatttacccttttccgacgttagcagatttgattcggcttccaggcctcaggctttcacttgagcaatggcaacagtaatacctataagcattattgttatcatatagatggacagagtcaatgccagataatgtcagcccacttcccttattcctcactataattgttactaatacgcgtttaaatgatacatgtgccaggcactgtgccaaaggctttacatggattattttattaaaccctcacaatcacagtttagtaaggagactgctgacaattgcccacattttatagatgagaaaattagacctcagggaagctaagtaaacttgctcaaggtcatacagctagttaatgctagagtttaacttccattccaaatgactccaggacctgagctcccaactgaagggcgctttcctccctcccctagaaccctcccttctctagttattttcaacaggacatttatcactctaaattccactgactgaaactcaatgacctgcggcaaacattattctaaggaacaatatttgcacaattttcatatcttaatgcagcaacttgagcttccatagagatttaaatccctaatgaaatttccttgtcaaaattcttgctgaaggattgtttaatttgctgctcatgatatcttcagaatgactgtatgctcaggaaataagcttccactcaactccctccctccattttttctcttctgtctcctctcttctctccattccatcttccttccttcctccctctctctcgtctgtccagtgcatacttttgctgagtgaaatccctattagcagggggtgagaaaccgctgctcttttattctctcccaggcaatgcaaagttagtcagaaatgtgtatcttttacattaaattttaaaaataaaatcttaaatgacctatatttaggaaaatggtgcaaggatgtcactgtgagagccttactggcttgagtgtcttagcagtggttcagagctgggtcctcagactgtttcaaaaactcatcccctctgctctcttttaaatcccaagaacctatagctaactccattcaggaacatatttacctatgaggatcaatcttataaagtgtgtcagtgacagtttttgtaaatatatctaatgcaccaatctgtcagattaatcaaaccctcctatggattcaatgtaccacaagtcgcattcagatcatgaggctgaatagcaagcaggagttcagaaagaatgtagtgagtgactcagactttggtcagagtcaagaggaagtgaccttctgtggaggagccggcatcagctactgtggcattcttgaagggcatatttctgcctcctgcctcctatgctgccagcgcactgagggatagcagcagtaagcttcccggaagctgacttgtagactcctgccctggttttccttccttactacccattcccacccagggtagttaccatcctcagccttgaagcacagttagatggagctgaactatgtgtcagtcagaactgtgagccagcgaaggtttttctccatctcccctctcatgagcacatgccaggctgagttcccatcaagatcctgacataatcaccagccaatggaagcatgggggatgctgcagagaacagactcagaacagaatcaaagaatgcagtggggtagagaagatgcccattggaagcaagggcacgcctcctcacacacagctggagacagccgtttctaccccaccctgtgcctttctctccctgtcagaatccagtacttagcatattcctggctgtgatggcaggcttgagtctgcaggctcaagctctggcaagcagtgtatacagcttaaacacttggagtcgtctagcccctccgtggaaggtaggagcatcacttccatcatgtattcatacgtgctgacttcgattcgcactttgtttctttgcatcttagaaacaggctctgttctcaaagcacctggaaagatgctaggagcctggtctggatgtgattcagaggaagactggtgaaaaatatgatatggatttagacttcccatcagcccactgggtttgtgtgcctcagctttccaggaagaaccacttcacaagtccctaaagaaaagaaaaaaacaatcttcggtagagtgtgttctagcaccagagagggcatcaggtaggaaaataaatttataaacacagccccacttccaaatggcctgcagagacaaccaaatcatgcccaagcttggtctccttcctcatgttcccagggattgtcattcccagtgcctagaccatcaggctcagagccaagtggtgcccctttgccatatgtgtcacagtgaaggaaaaaaaaattgagaacagcctgggaatgccaatgtagggccaggagcctgggtaggcatttgctaagcagacacaaggagattttcctgaagattattaacagaaagttttcccccaaaagacccatgttctgtattcttgcctttctcaattgtatttaatatataggaacatgtgttctgtgtgtcaacaattaggtgaaagggtgaaacaaaaggtgctctgaattggaagtcaaagggttttgttctaattctgtgaccacctgatctttgtggtgtggcctttggcaaagcacagtttatttggaccttggtttctttatctgtagaacaattccatgggcatccagcttaaagaaagtgatggccctcagcagagcaggctgtcttgcaagccattcagaaggggagttcagtgcaccaccaaactagtggatttcttcactcattcattcatttccccagataattaagcatatgtaacatataccatgctttggatccaaataataataatcacagatcctattgtcttaatccatttgggatgctatgaaaaaataccattaactgggtggcttataaacaacagaaatttatttctcactattgtgaatgctaggaagtcaagatcaaggtgctggcaggttcagtgtctgctgtgggcaattttctgatagagggtgcattctctgtttccttacattggaaggcatgacacaactctctgcgcctcttttggaagggcttgaatcctattcatgaggatttcttcttcccgatctatcacctcccaaaggcactgcctcttactagcaccacattaaggattaggtttccacataagaatttcggtgggacacaaactttcagaccatagcatctaccatcagtaaactcagtgtagttaactgtgtttattgacattgaattacagactacaaaggacgtaatgtctgcaagatattgaaatgttttcttccttcactcattcaaaatcttattaatagtttgacattggacaagttgcataacattaataaaccctggctttcttctttataaattaagatattctaatctgtaacatatatagctgttgctaggatgaaataaaatactccattcagagcatgtcatgcttgggacattgtgagagctcaataaatattatctattatcatcattattatttttgttgtttcaactgtcaccttgattagtacacagtgtacaaggcactgagacaggtgctactaaggattaaaaagcatgcagcctattacctggcctcgaatatctccagttgtactgaggaagtaaaaatgcatgaagaagtacaaatgaggacacacgaaagacatgattgctaaggaaatataaaaatggaggggcaataaaagttcacataaagtggaaggagagatctggtgttaggaaaggatttctctaggagagaagattgcagtgagctattcacacaggatgtgtatctgtgaactgttgtacaagctgcacactgcccgacttcactggtatcatttatgctagagtgtgaagggccttctgtggagggttgcaacttggtcctgggaaggacatttccatgaataaattagatagaggaaaaacagattcttgaggacacaaagcagaaactaattatcactttcccctggtctattaatccatacagatgaaagaatgtatcttccagactggcatctgctgggaatacttaagtctgctaagctactctgccttccaggagccataaaaacattgttagcagaatggatttatatgtaaaatctgtcactcttattaccgtttttctggcttgccatgagaaggagaaacagagaattatctgattttgaccatgtcaccatgaatctcacaaaacccattaattctgtcaggttgtatatttttatatatttgattgctaatatcttcaagtctttccttttaaattatatagacaccaatcttttaccaatcatgtatgcaaacacatgatttctagatactaggaaaataattttatttacaagaaaggaaaaatttcctatgggtacctgattcagagataaccactgataatcaattcgtgcatactactccacatattttctactttttctgtggcatacatatgtattcatttttatttgtttgtttggtttttagaggcagggtcttgctctgtcacccaggctggagtgcaatggcatgatcttggctcactgcagcctcaactttctgggctcaagtgagcttgcctcagcctcccaagtagctgggactacaaatgcctgccaccacactcaactactttttaaaaaaatgtttataaggacagggtcttgctatgttgcccaggctggtcttgaactcctggcctcaggagatcctcccatctcagtctcccaaagtgctgggattacaggcttgagccactgtgccagacttgtatttggttttaaccattatgttgaaagcaggcctcacagggccagagggaagcccacctgcccttgcctctctcagctagagtgtttgggtctgtctgcccagcttgctaactacagcttccctgttggccccggctcactgggggccactctacccactctacccgggaagaggattgttcttctgtcctcccagggggcctgttcagcaggtctgaagacagttcccaactggttctcggttctcctgtgtggtccacagctattccacaggacatgctcactatattgtatcattgtgccctgggagagctgggcattcaggagcctctgtcaccagactgtcaggatcaaagatgacacttcctctctgtcatctctcctctgtcctttttatagtttcaaagtcagagagggagatcaagtgttatggaatggttctagattatctaattatttcctttataaattctgcgtgtggtgttttgtctcacacttcattatctattattcattatattgacatcttaatcaaatctgaggtaccagaaattaaatattcataccttattacacaatatactcatttgccttacaaaattaggattggctggatgctcacgcttgtaatctcagcactttgggaagccatggtgtaagtactccttgagcccaggagttgaatatcagcctgggcagcataggaagaccttgtttctagacaaaaaaataaaataaaatagccaggcatggcggtatgcacctgtagtcccagctacttgggaggctgaagctggaggatcgcttgagctcaggagctcgaggctgctgtgagttgtgattgcgccactgcactccagcctgggtgatgtagtgagaccttttctcaattaataacaacaacaaaaaaaggaacaccatcaggattatactacctgtattttgtaacttctacttcccactcaatatattgtgagctttttcccacagaattttcttaattttatattcttttaaactattcttttatattcttttataaatattccttataatattataagaatttaacgtaaattattttaccagtcatctatgaagggctgtttagtgggtttccaattttgcctgcttacagtgattaacaaccattatgcgtaagtctctgtaccttgatgtccaaatgatttcttgaggataaattcctagattttgatatattttgataacttttcctccagaaagattatatctgtttacatttccgtgagtgaaaagtaaaattgattttacttttttctttaccaacactggatagtattaattgctacttgtacagggaaaattatataccactaatattttatattgtaccttgattgccagcaatattgaatccttttttcacttgtttattggtcagtttcatttgtacctttatgaatttttaattatttttctttgctcactttgaaatactataatatttcaatcttatttaaaagagtttgctattttgaggataacaaactattcactatcatataatttttccagattgctctttgatttattatttatgatattttttgaagcatacaaaagttttgccttttatggagtcaaatctattaggtattttttaaaaagtagttcatatgggctaatgctatccttagcctaagaatgaaatgaattaacagtaattaagctattcaattttattatatttctatctgaaatttatgttagtgtgtagttttatattaagagtaatatgtttaaaaacacatttaatttttccaacagaatttattcaatagtctgacatttcttgatgatttataaatataaattaattatataatatataattacacatatttggtgttgtctgtggactttctactctgcagataggggtaacaccatgagagtatttagttttaagagaattgtagtttacatttggtaagattatttcctcaatttaaaaatatataattggttaaatatgattcaaccatatattgatttgaacttgattacatatgcattttagaataatatgcttgaaaaacaaccaatatatgatattaaatacaatataggattcaaaacaacatgtatgttatgactagggtgaccatataacttatcatctaaactaggatatttggaaagtgaaaagcagagctatgaataattacactggaataaaaaatatgaggcaaaactatacactcacccaaatttgtaacataaacatgtatatacttaactacataggcttaaaaaaaacttgaaggcactgtattgcaaaatatggtaggattgcacaattttttcaatatcttttgtgtatctcccaattttctgcaacacatttatattgtatatattattatattatttatttttaattattattttaaatttaataaatattaaaagaatgacaataatgacaaatgcttttttgatgattactgccagggactgttctaagttttaacaaataatcctcacacagtgttgtaaggtagattaaatcaattcccactttaatgtgtggaaactgagaaaaataaagtaaataaataaatacataaataaataataaaataaataaaataatttgcccaaggatacacacttagtcaatggaagcactgaaattttaaacccattgggtatacagtctaaaaaaatagaacatgaagaagcagttacaaacattgagagaatcgctttcccatagagttataattatgattcctcacattgcttctcttcctttgagcatcattatttttgatgcaacttttcatactgttctgctgtattaggatttgtggtgtcttctaacaaattgcaatatgggttcctgtgtaaaacttgagggcttggagagaggagggttttatttagttttgtcttgacagttgcaacttcagttgcagtcggagtagggaaggctttgctgcaagccaccttgctgagacatgccctgaggtggtgctctgtgttcatttcctaagcagaaatttgctgttttgagacctccactctgctcatagcatgactccccagagagaaaatcctagcagtgtctctggtctctgcttatagggcacctacagctgaggttggtgtaagacaggtgtctcgtggccatggctacctgctcaagaaggtgtaaagcccaggacaaatgcctaagtttcaccactcgccctaccctctgctacctttgccctcatcctctccatgtgagcaatcttagtagggttcttatcactcctataaggtgtttggagcctgattctgctcaactctccatacagtttaattttatatacaagtttttgtagtgtatttctacctttactgtatttggcctgtcacttatatgtgaggatggtgcctccttctgagatttatccattgatgtagctccccctccacatcccatattcataattttttttcatggaaagcatatgtggggacagtcttttgtgagtattccaatggcctttttaactagaagtttccaaagggttcacttttgagtgagtagaaggaagcactgaaaaaaaaaaaaaaagatggaaaatggggccaagactacccgaagattaaaagcaaagaaacaataaccacaaaacccaattagccctcaatcaaaagggtccagcacattggagattactttcattctgccatccatagctttctgtgcttctttctcatagtccactttggataaatttcaatcacatctaataacatcacatgtgtcactagacagacacaaccactttctgcaaaattcagaggaaaaccataatcattttcaactctgttaactagactttcctaaatgaatctatttatttacattctatgcccaagagctacattttgaagataaatagcagaattacctatttcttttgatggtgttttacatgacactgatgttaggagacaaccaacacagtgctgtaccaagtaacacgcccatgatcctccttttcctgagacagctattttcatagaatatgatagagcaatttcaccaatgtgtgactgacatgaaatggaatggtttgagctattatcatctttatttctaatttggtactaccagcgtttcagtttttaatatagttttaaaaaattggacacatgaattataaataatatctcataatgtggattaagaacacaaacagagagaagcagaaaaactgactacattgttgacagtagtcagagacacagggttctgaattttctcttaagagaaacatctccttaggtccccttaggcccatatttcaagttccaacagagtttttcatggaatgaggacttaactgagtgccaaatttcatgctaggcctctgtctacacatccttatttattatttctgagttatagtaattttatggttgaggcaacagacattcagataaattaattcacctacaaaaataatcaatttgtaagaatttgaaatcaaatctgctgagtccacattttagccatcaaagggccttttgatatgggccaaccaaattttcttgcaataggaaactttttaatatttattttactttattttttcatgaggggtcaagagcaaaacattctccatcatttattgaaattaatatcttcattaagtgtcatgacaagaggtataattaaaaatgtaacttgaaatatgtcaaaagatggatgcataattagtacagtttggggtaaaatcattgcattaagcaaagcagtccaccgtatataacctaattcttgtacatgatacgcacttgacaaaactgtgaacaattaaaatgaatttttgatgatttgtttgatatgtggataaattttttagaaccagcactggatcttctgaattcctggctcccctaactatttttagtctctccttatgaataagctgtcagtggtcaattatactggttggtgtctccactgtctccattttcttgggaatcttgaaaagtcaatcccttagggaagttttgtttgagaattaaggtggaattgatctggcagataaacattagattcccactgtgctttaaaccatgagaaggttatcaaattttcagtttttcctgatttcttgtcttcacagaaaagctctgtgattatacatgcaggacatttttaaatattgggcataacccactttagttgtccaggaacacattccagatccaataggagtgctttgtggataatctgtaagtggtgttccttaattaagagtgagcaacagggaatttgtaaatcaaaaacacatccctatagtgtaagccaattcagctacaagtaacatttattaacaacctattctagttcatacaagaaaccttgccaggtacatgcacaaaagttctgtcatttaactcttacaagataaagtagctattagtatcctcatttttgaactatgtaaataagattagaaaaggaaaccctagatgaagaacatcatcaagacttattgtaagatataagaagaactaaattgagagataatagcatgacctaccatagaatacttttgtagaatggaattgttccttaaatatctattgctatagttccaaatacaatcctcagactatgtcttaaatgtttttcttagcttttgtttgtttgtttgtttcttgtgtatctaattatggaacttaatcaccagcttgttgaggacaaatatgctggatttggttaccactacatctcaagtgcctttcatgcttccattacatcaggcactcaggtaattttgattgaatgagtgaaagagagacttgtttaaggtaacatgttttactagctcccattttaaatgtggttttagtacacctactttaaaatttatttagtattcacccaatgtctatgactttgctaagaattatggataattaatacagtaacagtatattttattttattttaaaaacctattttaattgaatttaatttttaggatagtaatacattcacatggttcagtatcaaacagcataaagaggtttacaataaaatgtattctacccttatcccccatttacccagttcttctgtgataggcaatcaatgccgttaattccttgtaaatctttgtaaagctactgtataaacgtataagtaaaatgaacaaaaaatccccttatctctttttatataaataacagctcgtaatacacactgttccacatctcgctttttcatctagcaatgatctagctttttcatctaaaatgatcttcaagatcattttatttcagttcatacagaacattctaattctttttataattgtatacaattccattcattgcatatagcataatatgactgctatggtctgaatgttaatgttcccaccaaaaattcatatgttgaaacataattaccaatgtgatgacattaggaggtagattagatcatcagagtgaagtcctcatgaatgggattaatgaccttaaagaggctcaagagctgccttgcttcttccaccatgtgaggacacagcaagaagacgcagtataagtacaagggccttttacctgccagcactttgatcttggacttcccagcctttaggatcataataaatagatttctgttatttataaacgacccagtttatggtattttgttacagcaatccaaagggactcagaaaacgatgtaacaacccatctgtgaatttgcatttggtttatttgctgtttaaattatgctactttaagtagtatatagaataaatttctaaagtggaaaatgtgggtgaaatatatgtacctttatagacctttgggttctcctcattgtcatactactagaatggtaccaatttaaaatcttaaatcctctgttttccaaagcctctttgacatgacggtttgttttatgaaactatatttgtctttgtttaatcttagaagtgaagaatactaactcattcatttttaaatttaattctttttatgatgagtgacatgaaaacatctttttatattttaaaagttttttattttttctttcctgtgaagtctctttaatattcctccccagtgtgtaattcagttattggtgattttcttattgatttgtaggagctatttttatttaagggaaatgaggcctttgattatgacatgagattgaagtagtttttttcttttgatctttgcattttgtctttgattatgatagttcaggcacaacaggaaacttctttttcctttctttttttccatgcattcctcttttctccctccctccttctttctttcctctcttcatttctttgtttttccttccttctttctttctttcttttattcttttattagaataattcattttttaccattgtggctattgggttttgtttactacctttaaaaagttccaccgggagtggtggctcacacctgcaatcccagcactttgggaggctgaggtgggcagatcatgaggttaggagattgagaccatcctggccaacatggtgaaaccccgtctttactaaatatacaaaaattacctgggcatggtggcacatgcatgtaatcctagttctttgggaggttgaggcaggagaattgcttgagccagggagtcagaggttgcagtgagccaagatcatgcctctgcactccagcctggcaaaagagtgagactccatctcaaaaaaaaaaaaaaaagttccttctcactccaaatttattcactaatatttctatctaaaaattttaggaatgtaattatttcagtattttttccttaaatcttgaaatgaatccagacttcttttttcctagatgattacacagattcccaagatcatttaattagtaatattattagcagcatatttgtcagtattaaatcgtatttatttattaataatgtcatattcttataaatgaatgaaaagatacataatgaaatatttcacatttatttggttctatttctattctgttctatggatccatatatttgtacatcattataatattcttaattattagggttttattaaatatattaaaatatataaaaggagagcatacccttcgttagctgtcttccatatcccccaaaatttgtatttgggttttatgaactcatttctgtctcaccagtgattactaatatatacttaggagttgattgttacacttaaaggtagctatgatgaaacatgagttaatgaagcagaagaagccaggctacataatgagagaagattaaaataacagagaaaggggggaaaagaaaaaaaaaaaaagcagataaagattgctttgcttctggaaatggcaacccaactaactctcttatttttttcatagccaggaaagaaaacttactatcatttccaaatgacaagcctcaacccaatttaattagctttaccttgagatccagagaccaatcctgttctatgtagctttatttgactcctaacatcccttgatctttctattctgtggggtgtttcattatctaaagcaaatatatactacttaaacataaaaaattgtaacattatgaggggtgactcattactggtgtgtaatatcatggtaccagacattactaatatgtaaggagcatgagcagaaagacaccagcctgtgtatagccatagactactatgcttttaattgttttgagattgagtgtctcaagatctagataaatcagcaagatgaaagatgctgaacactgacatcttctttgtgccttgtgaaaagaaacaaatgacatctctgagctgcttagaaaagaattatacctgggatagtggtcaagagtggggagatatatctcaggagagtctcaggtagtttgagtttttttcctgttcccttcataacaaacatgattcacagcaaccattgtagtattatcagtaaacaaggctcctgtttacatggtgacctgaaatagaccctgtagccagacatatccatccttccttgttccaaacacacaaattttactatactgcctttgtagtcactaccattttccttcaatggagttactttcttcctgcagtaatctcatagtaatttgtacactcttctcaaacaatcaacctcaaaaggatctaccatttgttggacacctaatacttcttttgaacacttgatctcattttatctcagcctctctgcccaaaaaatcatctagattgatattactgctgtcatttttcaggctagatgctgaatcctatttctagctgaagcttaggccatagcttcacttcaggctgcagcagaataagggaagggaagaatctgagtcccctggcttccactggggtggggagtttcctcagagatagggagaattcttccaaccaaaggaaatttgggaaatattaggaaacaggattatctgctgagaaggacaaaaccattccactgtaaatcaattgattaatccacatacaaacaacaggttttcttgcacaggaaaaactctgacacatattttactttacttttgtccttaaggacctgatgataggcctaggtacaccatctacttcacatttttctaatcttcctgtttaatgtcgcaatcaaacaagaaaagaagcagctttacttgttccttgtaaaccatgttgtccctcagtgatgccagcatcttccactggctcatattgaccaatatttcatacaagtgttcttgcaccttgcagttgcacctagcatcttcctgatttacagtctcagaactcgctctgtagacaccttttttttttctaaactgaaaacgtaccgtttgttttccatcttcctgtaactcctctaagaaagcagatggtggatcagatctcaggccaaagttctctccagatatgggatataatccaagcaacctggtacctgggaactcatttttactcctgtgagctcttatccatcattctggacttcagcagctgctcttcagcgtctgtttattcttttctactgaactcccttctctttgacagaaagcgtggctacagaaaacattctgactaattctgtttggggtcagtcatgaataactttattccaacagcttccaatggcaggcaaatcctttcccggttttacatactaatgtaaaataattctcaaggataaatctatgcttaacatattcaaattaaactttccagtcagataatatattctccttaatgtgcccagtgtatgtagttcgtagtatacactaactgcaatctactgatttatttgattgtgcacctaaaatatacaagtagtacatttcacaagtaagtacaaattcttcttttcagagtggagaaagaaatatatggatcctgtcctcatggaacttatacagatgataactaacactagttactacttaatttaaaagtggtacaaagtaccaggaagtaaatgtccagaatgcaataatgatatgtaacagtgaaacaaactggaccttgttggagagaaggttttcaggaatatattcattcagtcattcattcaacacttgctgtgaaccaagcactactgtttttttttttttcttatttggaaaaaagctgcatatttcattgactcttctgaacaaaggtcattaatacaaaagcacttgtaagttgctttacctggggaaagtattttggtgatttttatctaggtgaagttttctgggctcaaaaatcttttcctaacaggttgattttaataacagtccaaactattccaaaacaaaacaaaactgttttcctctcttcctaaacagaaacaatggcatccggagctgaaaatagcgttaattacatgaaaagtttgtgatgcacaggatttgctctggagtatgaaaagtgtgtcttagacttatgtttatactcacataaaatgagcaaaaaacgatagtcctcttcaggaagagattatctgatgaaaatctgcaaagatacttcaatctttctatgtactggagagtttatgaagccccaaccactgttctaagtagtgagacactttaccactttttgtacacgtgttgggttggagagtgacagattgaaaataaatatggaaattactgaataaacttatcagacagtgataaggtaattcagtagagaatgattagattgctactttattctgagtttcactagagaagaaatatttaaactgagatctgaataacaagaaagaaaattcttcggggaaggagcattccatagggagaaaacatccatggaaaagaccttaagcctgggataaacctgatatgctcaaaacaaaataaaacatacacacaaaatgtcagaatgaatgatgcaatatattggatgaagaggaatgtgatcatatcattgtcatcctaatgacgacccctttgagagtgaaaggagatgatgctctgtataataataaccaggccacaagcaggcatgcagccccttctggttgaataattgagaaacgaaagtctgctagaaggagaggctcaataaatatttgttgaaggaaggaataattgctctcactctaatggaatttttttttaaatttcttaacaaattgatttaattaaatctagttctagatgtatttatattttaaaatattttaatttgggcatttttggcttgatttggtcagtgtctttgtttttagagctccagatggctccaaaatatttttgttctcagcctttctctatgttaatactatcagtgaggccaacttagacaggtgtcccatgtgaattgcaattatttcacctcaaatggtttgtcttaccctagtcaaaacaaagcagctttgatttactacagttgaggtagaagagagattgctgaaggttacaagcctgattctgcttttattgtgtcatttgaggttgacctttatgctccagtaacctccctgaatctgtgtttttccaagtgtctgtaatgctcagtgttgggcatagccctggatgacactttcagatgaggaagtctgctgaacatctggctaaaaagcaagttttggagagcattttaggacttaaaatataaagtctaacagttttctgtattataaatgaccagatcagcatctatagatgtatttttatgagtaataaagtataaggggaaaggcttgcagagagaaaaagcaaggaagagaagtatgtcaatgaatacaaattctctcatttgataagaaaatgtaaaattatgaataaatgtatgacatctcattgcaagatatgataagactcaatttcccctgtttattgtcaccgaatatctaggaaacaaaaattttcaggacttcagtattttagcaggaagaaatctagtgactatagattgcctacccctcaccatctcaccagtgaaggtcttggtcagtagtctgtagctctccattttctgccccctaaatgtgtcttgcagtgagtggtcagtggtcaaatgaatggaacagtagaggcacttctatatcagcatgaaaaaccagtgaaatgctgtcttgccaatactgtgtatacagagagacatttataaaataataagcaggtaaaacttgtcttggcaaaaggctggctcattacattcagtgaatgttaaaaaaaaaaaaaagtcctctgtggtgataagtaaaatagaccatcaccacccaaatcaagccacattaacatcttgaactgctatgctttggatatggtttgtccctgccaaaactcatgttgaaatttgatccccaatggggcagtgttgggaggtaggacctagtgagagatgtttgggccatgggggcagatctgtcatgaagagattaatgtcctcttacaagtaagttctccatctaaagggaatgggttagtctggtgttaaaaggagcctggctttcttggtctctctctctctctctcttacttcctctcttactacgcaatctgtttgcatatgcctactcccattctactttctgccttaaattgaagcagcatgaggccctcaccagatgcagctgatacatgctgagagtaaattaaaccttccagtcaccagaattgttagccaaataaacctcttttgtttgtagaaaatcttgaactttccagtcaccagaattgttagccaaataaacctcttttctttgtagattgcccagactcaaaaattcttttataacaactctaaacagagacattaaccaacagcaggagttaatgaaaccaaaagtatgtcatgaggacagaaaatgtcaaatattttaccaaaatctttgggaagtctttcaaatgtcaaaccaatcacatcactgagatcctgcacatagagctcctggttacctcttgacacaggtagcaccctctaaagtgagagcaccagtggtgatatccttagccaaagtgatgagaagttgtatgttccagcaaaagtagcataacacaaaaacatacaagtgtttgagacaaagaagactcttaaccagggttcctagctttcattgagaaaatcctctcaatacatccttatcactcaaaaaattgaaatccattataataataatcatactaatctattgatgaaataataagaaacagcggaaggaaggatggtaggtaacagtcggcacaagacacacaaagaggaaactctatgggttctgcatgcgtgagttgctgaaaatgagctttaaggttaaagccaggagtttggaattaatgtgtagcatgtgaaatataaaaaactccattcaatgccctcaattttatcagaggattagggtaacctcctggatacttgcagaaaaaagaaagccagcaataagcatttggctgtggcttggaggtttaatttactctcagcatgtagcatgggaacctttttgcctgagttgagaaaatagcctataaactagcaccacaaccccagaaaaacacagggccccagtagagacaaacagaagaacttccaacagagatgcccacagccaaaagcacatctggtctctaaagaataactcatgatgctagtgatctcacaggaaaaattacaacaaagataagaaaaaagcatataagaaaatcttcataagagaattgtcagcagatgtagaaatcaatccagaatgcagccaaagagaaaacatgaacaatgtgtgaattaaaagcagataaatatagcataccaaataccaaggaagagaaaaacattactctgataattaatagcgaagcataatcatcaaaaaggcaaagtaccactatcgtctctgtcatctaacttcatactgaagctttaagtaagcctaataacagaataagaaaaaagagaaagaacattacaaaatgaaataaaactatattattctgcattacagaggctatggttttatctacttagaaaataaaaaaataaataaatagagaatagctaccaaaactaaagaactaataaaatcagcatacagaagacagtcttacatacagacaactataactaattagaaaatataattttaacagattttttaataagaaatctattacattttctgattttattagtgtatgtacatggcaatggcatacataattaaatgtatattacaaatgtaaactaagtatatattgtaaaaaaattaaaaatatcatattcccaacagcttcaaatgttatataacgtagactctcaggagactaggtactcttagaactagaaaaaaaaattcaataaatagcactgaggaaattgggtgcccacatgaaaataattaaatgtatttcatatttttaaaaatctacagatgacttgagctaattataaaaaaaactctaaaactttgagaagaaaatatagaatattttatgatatatagcaaaaatgtaatattttcaaggaagaaagtaaaacatatcgaaaccaaagttaaagcaaactgacttctattttatcaaggcttatctaaaaacacaatagcaattcttcagaaatatctgtggaacccttctaaattaattataacctcactataataaaaaagtaatatcttcaagaaaataaggcatttttagagaccatttgtagccatagtgcaataaaacaagaagcaaaaacaaagtaacagaaaataacccaaatactttcctattccaacaaacaaaaaccaaaactcttctaaagaatccttagcttaaattggaatcaaagctgcaataacaaacattttgttagaaaataacagtagacaatcatcatttaaattctgttgataaagtgctcagcataaaaacctgagactgaattgctacttttcagtaaaaacaacataaaccagaagtcagaaataattttaagagaaggaaaatcaaaagtcaatgcatttgaaaaaataaaattaataaaatatataaaattaagaaataaatcagtttggcttgtaataattccagtaatggaatgaaataattatttagaaagcaaggaaaaacataaatggaatgcttctcagtattttcaaaataaaaaaattaagttaaaattataaaacatatatatgtgtatgcacaaatataaattgtatttttttctttttcctttttttcttctttcttcctttcttccttccgttctttcttctttctttctttctctttctttctttctttctttctttctttctttctttctttctttctttcttttctttctttcttctttcttttcctttctctctttctttctttcttttctttctttcttctttcttttcctttctctctttctttctttctttttttttgataggacctcactctgttgcctaggtgggagtgcagtggtgcaatcacagctcactgcagcctccgcctcgccagctaggtttttggattgtttgcagatatgggttttcaccatgttgcccaggctggtctcaaacttctgggctcaagcaatccacccaccttagactcccaaagtgctgggattacaggcatgagccaccacacccagccacaaatagaaattttccaatttccattatgaatgagaaaaatgaataaaacaagaattataaaattaaatttttcaaacgctaattaaaaatacttgaaaagtttaccagccccaatgtttatataattccatgccatttaaattactttaaagcataggccatacaatgcaaactcaattcattgaataagacacacaaatgatacatgaaatctgacagtgatagcaatacattgaatatataaatcaatttgaattatgaatagtaatgcagaaatgtggaaatcagttcttccgtatacatatatacatttgcatgcatgcctgtgtgtctgtgtatacttgattctaaggaatgaatgaaaataatagttaacaaaatagcctagactttattcaatgtattcaactcttgtcttcaatatattccactgagaatgttgtagttataacactatatcctgtaccaagctttccatgtcaactagctttttgtttagtcacgcatagtatgctgtggtttgaatgtgtgccccaaaacccatgttgaagttcagttgccatggtgatgatattaagagtcagggccgttaagaggtgattagtcctgagggctctgccctcatgaatggattaatgctgttattgtccatctcctctttaaaatgatgcatccaaaagtctctgaaatgcatttgatttgtataaagagttattgccaaactgcccttttcagtgacaacatttatacactaacaaacatggttttttgtgacacctgattcttgcccagtgtttatggggtacagtgatttcatgaaaagcacacctagctgaaatttggggaacaattgtttcatgtagaaagaatgaatcttagattgtattaaaattcaaatatgccatgacaaacagcgaccttttccagaggttttgtaataatcactcagcatgaggatgtcaattaataaatatgtgaaagcacattgataggccacaggaaaaattcatgtaaccatcctgaaatgcagaaagtattaaagaaatatccatttatccttaaagactcttagtaaaatatatttgaaaagtactttcctcatataatgaaagataattatctaaaataaattgacaaatatcaaaatagcaatagaattatagaggaattcctcttaaatttaaaacaaaacttagacttgtagcataaaacaaagaaaaataaaatttaaaaaactattttggattgctgaccaaattaataacaaataatcaaaataattaatatacgagtaaagaacattatcaatatgtgcagttttttgtacttggaaaccccaagataaatgagaaacaactttgaacacttcccatgttcaaaaaaaaaagtgactgactttgaaatcttcatacaaaaatcatttaatttataatgtcttatctgtccagtatggtggccattggtcatatgtggctgttgatcatacagaatgtgtctagtccaaattaagatgctctgcaagtaaaatatgtgtattagaattcaaagacttcatgtagaaaaaaagaaatgtaaaataactcattttactttttaatttttattagatgttgacatgataatatttggacatattgaatgaagtaaaatatgttaaaattaatccatctgtttctttttactcttttaatgtggatagtggaaaatttttaattgcatacatggcttgcatatgactcacattatatttcctttttctttttttttgagacagagtctcagtctgtcaccctgaagtacagtggagtggtcttggctcactgcaacttctgcctcccaggttcaagagatttttctgcttcatcctcctgagcacctgggaatacaggcatgcgccaccacacccaactactttttgtacttttagtggagatggggttttgccatgttgaccaggctggtctcgaactcgtagcctcaagtgatctgcccgcttcagctttctagagtgcttggattacaggtgtgagccaccagacccggcttcacattatatttctattaaaccacattgccctatgcaaatttttttttttttttttttttgagacttagtctcgctctgtcgcctaagtgcagtggtgcaatctcggctcactgcaacctgtgttcaagcgattctcctgcctcagcctcccgagtagctgagattacaggcacccaccgccacgcctggctaatttttgtatttttggtaaagacagggcttcaccatgttggccaggcaagtctcgaactcctgacctcaggtgatccgcccacctcagcctcccaaagtgctcccaaagtactcccaaagtacaggcatgagccaccacacccagccagcaaataaaaaatttttaaaaaagataatatgatagggaaattatttctttttgtaaaagcagtgcaaagtcagtaaactctaggtataaaaatataagatagtataagatgctgcagcaactgtatgattaaaactatgaagctatgttttgggctgtgtgtgtgtgagacagagagagcaacagaaagagaggaaagaaaagagagagagagaaagacagagaagaaggttcctgccatgctccttatttgaaaatcatgtcatatgacaaagtgtagtttaaattatactgcctagaactctttattcagtatgatccaatatcaaattatcaatattataaagaaggaaatgcttgctaaagtgattggtaaattcaatacagttttcattaaaaatatattttggaaagggtttgaactattttaaaattcttcagaataaacacctgagaaaaccagaacaaaaaccagtacctatgaacaatagaaaataaagaagacattttaactaagtaagaaaataatgcattatttaatattgggctagctctctaaccatatggaaatgaaagtataaaattcaattatttttcttacaattcacacaaaataaattttagaggattaaagttttacatatgatacaatgacaaagtaatataagtaaaccaaacaatcaaaaatataatcttattggatggaaagcatacttacacatgatacaaatgttagaattattatagaaatgattataaataaacagaaagtgaaatgggataagttgttcaacctcactgtagcgaagaaaatgcaaactaaaggatgctaattactcagaaattgaaatttatcaccattcattaaattaacactattttccaggagaagtgacaaataccaaaggtaggaatataggaatgaagatgttataaagaaaaaagccataacaaacaatcaattcagtaattcattttacttttctcttttcctcatgcaagttccctttgatggaaaattattgttggaggaatgtggtatcctgatccaaaatgataataatgtggtatgcatataactatttactttcttgtaatgtgtagcaaggtttgtagactgaattttagtttgtggaatgaataaatatcatctatatgaacatgattttttgaattattttgaaatgtcagctcttaactgacatagcaagtcatctctaagtaataaaatttaatatcagatttgatttccactcagaatttgtgtgtttaaggttttcattgcaaaaaagataatatagctttgcagaagttagacagttatttcctattcaattgctttgatgtgcctatttctttgaacaaaatctctttttaaatgctcttttgatatgtgagctcatggttgctctgaaattaatcccaaatgcaaaatgctcgtgaagaatttagagtttgctaaaagtagttattttgatacatttgttgatattttcttgatagggaatgaaccataatttactttaattatttttacgtgtgaatgtacgaaagtaaacagcagcaaccaccactttctaaagcagaaagtattttgtggccaggttttctcttggctcttaggagggccttctcgtctttattgtgatgctgacatgtgatacagacaatgaagactgaagtggtcagcctgaacaataacaaaaatgaccacaactagtcacagacttagaaaacacttctttcacacttttgtctataaagatctgcttatattgaatggaaatgaaccctaaaaatagtctagtttaaggataaggatcacattttataatttgcttgaggttggttgggctagtagctaatttaaatataggtctaaatgttctagtataacattgtttctcttatcctttctgtggtcttgctagtggggatggagtgtgggtagagttatcttgtagttcagctattagaaaactgtttcttcttcatcccagaataaatcttctacatcaagtagtacgctgattaccttctgtaattaaagacaaaaatgtatacatgtatttcctatttcatcagtcagtttgactgatatctgactccttacttattaaatgaagatattagcatccttagtcttttttttaatctctcttccctaggcccttctgtcttcccatttctgttgtttgttaagaacacttaaatatagcgtcaccataaatatatttttcttaccttactcataggtatattttgaaatctagtactctacgaagactaatcaccttaatatgtggatatattgtggatatatatatatatgatatatataaatccttatatatatatataaggatgatatatataaatccttaatatgtggatacaatgatccattgtaaaatcaagtatgaaattttgattatatttcctttcagtatagcttcttggattgttggtccagctagcaactctattaattctctccctccaatactcacagtgaccagttatttcaccttgtctcctggagcacccatctatcacacaaacagataccttctcaatctgctgcctgcatgtcttcttgggatttatctgcactgtttgcctgggttgcgtacttcatttttggattttcttgctttcctgtttttaattttgtttttcctcctttggctaaataaggaccatatattccctgagtatttctagagtgtctgaaaaatgtctttattctatgctcacactaccaggatcttttagcatttttcttcacgggttcttttaatctagagattcctgttcatctgctctattaaatacactttattatggtctggatagttttcatctctacattttattttttcttttctgttttctcattcttaaatttctcttggttggctattggatctcctggattggttttcttaatcttattatcttaccttttcccagtctttgtccatttcttttatttattgagaaatgttcatatattcctagtcttttatttattctttttatcttaactataacactgtaaattccaagatatcagatgtctcctttcctcaggaatttccattacattttacaggtgaaatactttttttgaatgtctctaaggatattactgttggtaatataatattttcttattttctatgaattatctctgttctctctctctctctctctctctctcatcctctgttcatgtttaagagtaaagtatgaggagttctttgagaactctgcgtatgtccatagtgctcctcaccttggagcaggccttcattttaagatgcttgacttggagctggtgtcattttggaggcccccagataccagaatgtcactggagtcacactctctcaacagatggccttccaggctcctttctaaaggcggatgcctgaccactgactgttgcaagtcaagagtaggagaaatgtgtctaggagtacgtattgtatctgtccccctccccacttcatgtgttcagttccatgtctttctttcactttcacgtgtactaggcacgtttttagtctcagacttctctgtggttttactaggagagctgtctcacttctcagttgtgtcccacactgcatttttctccatcccagttcaatagttaccactcttccatggacatgtggccttcaagagtttatagaaactttttataccctgatggttctttatcaacctcttgtttgtcgtagtgacctatttttttatacttacatttatttggttcccatgaaggaaagaaaatagatgcatgtggttaatccctcatccttaggctagaagttaccccaagaaattttaatttccatgttaataacccacctagcaccaagtaattgtagagattttcatctcttcaagaaaacagataaaatatttgtctcatcttctggctttctgtatgcagtatataaaacatttttctttcactgatagcaattcatgttattaactattttaatgatataaaatatctcactttattttaagtaatttaattttatctctttcatctgattaagatagattttctagcttcttaagttgtttaatgcaaagacaaggcttttgacagaaaatccatgtcacagtctaggaaatagcttttttgtgtgtgtacctacatttctgacgttcaagtttgttcccaaatttaaactcaaccctcaagcaatttgatttttgaacaaaaagaaatgttatatgtgttctctttctatgtatttaagattctatacgctttaagaagcaattactaataaaactgagattctaacagtcaaaattgtcagtagttttatcatcatctttgtcagtctttgacgactacagatgaaaggctccaaattgtactagattatttgtaacattttaacccataaagaaaatggaaataaatagtttgtgaaatatggttatcattaccaacctatatgtttttgccattagaagtcattttaacttttagtacataacaactaggatattacataattctcatgtgacttctattctttttaccaccctagaatacctgaagcaccagttcaaaggctgagttgtacttacatattctaaatgtttccatagttcctgcaaatattgactgatatcttgagaaaatataccttcaagagtttaatcatttaccttaaattgaaaatttgtattttaatggattctgggctgaattatgactgtcgattttaaataactttaattacttgaatttaggaaaattaataacataatttcaatattaaaaaaatattttgagatatatttctcaagtataatttaagagtaaagcagttcttatcactgtgatatgtgtttaggatatgtgtgattcagattgctgattttaacaaataactattctgcacagtgaagtagaaagcaatagactaggattagaagactaaattttaaacctcagctgtgaaaaatcagaagtctaaaaattactagcacaagtcaaaaaatcaagcctttcttttctcctaagtgtggatttatgtaattcttcctacatatctttttttctctatctaaattgtataaatataaccaaatataacattttttgtgtacacgctcagacatgtatacctaatacagtgtttaagacctgcaagatttcattgatgaacaagttgctttgcttgatattaataaacttgccaatttaggacgtgatgcagacccagccctcatttctgtaaggattgaatcctgagtctgtaacttagccaatcataatgttattaaagtagaaatattctgtacttagtgtgggatataagtgtatataaagcaaccatgaactccacacctttaatgaatagaataaaaatgagtcattatattattcttatttatttagtttttacatgtactcttactctccattctgttttttaaatatgaaaatgaaatagcagcatgactatgcatagtatttcaactacaataaattataaaagtgaaaggcttacattttaatgattataataatttagaaaggcatttcaaaactttccattattttctattcaagtactttagtaaaatgggtgggtatatcaagaatcttagcagagtttacaagacactattcctggtgaagacccctctttccaaaaccctgttgtgaacaaagtcacgttcttactcacagctctattcttggaaacacattattttgcaaattcctaatacgacgattttctaaaaccgtcaacacaaacggacatcctagtttgtaccagaatatgtctccctcaggaggtggcttgggcttctctgccatggctgacagacattgtagaagcagagagtcctgagaaaaacagaaaagccctcagatcagaggaggaaagaaacaaacactaggaggtgttttggcaatttaaacatattccaggttaagcagcatcagaatggacaccagggtagaccataacctcagaagggcatagtagatatgatagaaatgtaggctgagattggagataagggctggcaggaaactcattgtcctccttggagctaagtggagcaaaaaatggaactctattttgggtgtcttggacaaggaacagaatactcaggagctctagggaaaaatggaattcgggtctcccctggggacatttatcagaatgaagagaaaaaataaacaggcagctgcatcctaaaggtatcaagtgagcctctggcatgaactccctgagagttggtttagcaaaagtagtaataatgtgcagatttgtgggacaaagctttttgaattaatgatccaaggatttatctctggctcctggatggtaatgaaagatcatgcaagtgtctcagtacaaccagctagggtgagttaggatgaagcaaagggtgccaggcagattaacattctggtataaatttgttatacttttatcaccttccttcttaaacaagttactaatcttggaaaaattagaaataatatgagataaaatttgacatgctcttaatgaactgatcaacttcaatgatctaatcgagtcatatgaatgaagtattctttttaacgttaaaaaatgaaatgttttcaagtgattaaaaatttaaaagaagacataaaataaagccagtattttattctataaccacctatgttgggatgtaaatcataggtactatagttgctgacaagggttccattctggtgtatggaaaggcatcccacagttatagtcaggctcatttactgtggactcgtgatgcccccagcagtctggctgatcttcagaagtgtggcaatctgttcttattccatgtaagtttgtctaccaagctggttgccgcagagggaaaaacattcttactgcttagaggaaaataaacttattcacttaattattcattcaacacttaccaaaattattaatacttaatcagtgctaagtcctggatgagctattcctcattcaatgaagaattgatgaatcactatgttataacattagtggctgacatcaaattgtccatctcaatagcacttcaagcaaacaaacaataaaagtgagctcattatttttttttcctcccaattctgtttcctttgacatttatatcaacattcactctgttgtctaaatcaattttggatttacctttgatttctccctcttacttaacactcatattcaaacaaatctttgtgctttatttattcttcatctaaaagtacttcaaaatctatttccttcttcattgtcatctcagtttaaactctaccatccttccacatgggattatgaatattgtctcccagccaacttctttgcctttctcttttgttgaattaacttttgatgtctactttttttcaaattttgaggtaagctaattttattcttttttaacataaattttattatgcatatttgaggtttataacgtgatgttatgggatacatacagagggtaaaatggttactctagtgaaacagattagcagatctatcatctaacatagttactctgtttatctgcttctaggagtcagaaaacatatagttacttttcattcattcattcattcattcattcattcattcataatctactcatttaatgagaattcttagtacaatacaattttattaatcatagttgtcatgttgcacattagatctctagacttgcttaatcctatatatctgtcactttgtgtcctttcctgtatctcccctttccccactcccttgtgcccttaataaccactgttttattctatatctctgtatatttgtcatcttttttttccaaatattccacatataattgagatcatgcaatatgttttctgtctgtgtttggcttatttcacttaacataaggtcttctggggtcatccatgtcgtaacaaatggcaacgtcttccttttaaagtattacccatggtttccagtttgcttccatatctttttttttttttttttttttgagatggtctcactctatcacccaggctggaatatactgatgtgatcatagttcattgcagcctcgacctcctgggctcaagcaacactctgacctcagcctcccaagtaggtgggggaacaaacatgtgccaccgtgaccaactaattttttattttttgtagagacaagatctccctatgttgctcaggatggtcttgaactcctaggctcaagtgatccttttacctcagcttcctgaagttctgggattatgatcatgagccaccctgcagagcctgtttccgtatcttggctattatgaataatgttacagtgaacatggagtgaagatatctttgtgaggtggcaatttcatctcctttatgtatatacctggaaatgagattgctgagtcatatggttgttctgtttttaatttctttagtaacctccatactgtttttgataatggctatactaatctacattcccgccaactgtgcactgggttcactttccaactgggttcaccttgccaacacttattgcttgtcttttaggtcatagccattctaccaggtgtgatgtgattatatcctagtgattttaatttgcatttccttgataataaatgaaaatgaggccaaaatgaaatgttgggcattgttatgtcttctttggagaaatgtctgtttaggtcctttgtcccttttttccttgggtcatttgattttcagctatcgggttgtaaatgatcttaataaattttggatattaatcccttatcagatatatagcttgcaaatattttttccacatttgtagattgccttttcattttgttgattgtttcatttgctgtgtagaagatttttagtttaatatagatccatttatttatttttgtttttgtagcttgaaatttactttttcctttccaatttggatgcttattgttattattttatcatcattattatcaattaattaattttcttatcttatatctcttgctagcacttccagtactatgttgaatagaagtggcaagagtgggcatctctgccttgtaccagatcttgatagaaaagtttacagttgttccctattgattataatgttagctgtgagattttcattaatagcttttattatatggagaaacttttcttctgtaccaaaactgttatgtgtttttatcaagaaaagatactgaactttgtgacactttttttctgcagctgttgagctgatcatgcttttatttttcattctgttaatgtgatatatcacagtgactgatttgcatatattaaactggctttgcatgccagggatatatcacacttggtcatcatgtataatttttttgacgtgttgctaaattagttttgctagtgtttcattgagtattgttacattaatgttcattagacataatttttttgctgtgttgctgaattagttttgctagtgttttattgagtatttttacactaatgttcattagacatattgacttccagttttcttttcctgtgggatctttctctagcttaagtagaaaggtaattctagccttgtaagatgtttttggaacatcccattattttgggaaagagtttgagaaggattggcaataattatttgaatatttggcagaattcaaccatgaagtaatctggctctaggcttttctttgtttaaaagtttttaatgtcttcttcaacctctttattgtattattggtttgtttaagcttcctattttgtgttgattcaatcttggtaggctgtattttttttctagaaatttgttcatttcctctaggttatcaatatgttaacatataattgttcacaatagccgattatgatccttcttttttatttctgaggcatctgttataaggtcttcactttcatttctattttatgtacttgagtcttcactctttttttcttagtctagttagatgttttttgattttgtttactttttcaaagaaacaactcttggttttattgatttttttgttttatttttctgttctctatttgatttatgttctgatcctttttattccccagttttattttcctttttcttttttctttttttttttttttttttttgagatggagtcttactctgtcgtccaggctgttaatgtggcatgatctcagctcactgcaacctctgcctcctggtttcaagcgattcttgtgcatgcctcagcctcctgagtagctgggattataggtgcttgccaccatgccaggctaatttttgtatttttagtagagacagagttttgccatgttggccaggctggtcttgaactcctgacctcaagtgatctgctgcctcagcctctcaaagtgctgggattataggtgtgagccaccgtgcccagcctattatttcatttcttctgataaatttgggtttagtttcgcttcttcactggttcctagaggcataatatagggctatatatttgggatcttttttttttttttaagtaggcatttcttgctataaagattcctctagaactgcttttgctatatcccataggtttttatatgttgtgtttctattgtcatttgactcaataattttttgttaaattctcttttgatttgttctttgaccaattggttgttcatgagcatgttgtttaaattctttatatttgtgaatttaccaagattccttctgttattgatatctagtttcatatacttatagttcaaaataatactagatatgatttctatctactcaaattttttaatacttgttttgtggcatatatggtgcattctggggaatgttccatgtgcacaagagaagaatgtatattctgctgttgttgtatggaaacttttatacatgtctattaggtcaatttggtcaaaattgcatttcaagttctatattttctcattgattttctaactggctgatctattattaatagtgaggtattggcatccactagtattattatactgttgaaagtgaggtattgaagttccctactattattgtattgttatctatttattattttatgttcattaatattggctttatgtgtttaggtgctttagtgttacccactcccctacaatttatacttttgttgtcacaatttacatctttttatcatatatttcttaatagcttattgtagctataattgtgaccattttgacttttaaccttcatagtagacacttgaaatatttacacattgtcattgcagtaatggaatattctgaattttactataaatttatttctatcagtgagttttatacttttatatatttccattatagtaattataatccttttatttccaattgaaaagctaaacattttttgtaaggcagttctattggtgatacatcttctgacattttgcatatctgaaataatttgtttctccttcatttttgaagaacagctttattggctataccattttaggttggcagttttcttctttcagcactttgactatcttatctcattcttttctgacctgtgatatttctgctgagaaatcactgatgatctgatggggattcccttttatgtcacttgacattttcctcttgctgattttccaattttctctttgtctttgacttttgacattttgattataatatgcctcagtgagcacccctttggtagaatatgcttgaagacttttgagcttcatggatctgtatgttcatatctctcacccaacttgggaagtctttagctattattttgtcaaataagctttatgtgcctttttccatctctttaccctctgaaactctcataatctgaatatttattcacttaatggtgtttaataagtcccatagactttctttttcttcactctttttcattttttttctctccgggttattttaaaagatctgttttcaagttcagacagactttttgctgcttgatctagtctgctgttgactcttacatgtacttcttatttcattcaccaccttcttcaactcgcgtatttctgtttggtcctttcttatatctatctctttcttaaatttcacaatcagattatgaattattttcttgatcttactgaattgtctatctgtatcctcttgtatatcatgaattccctttatatgattatgtattcatcttcaggcaatttgtaattttcatttatatggggttagctactgaggaactgttgtgtttctttggtggtgtcatgttcccttgctttttcatgtttcttgtgtccctgtgttgatatctgtgcatctagaggaacagtaactacttttaattttatagattgttttttgtaggaaaaaactttcatttgcagatgggtcttagggtgtcatttggacagggtccattgcctccagttctgtgtgagtgcagtggtgtagcctttgtgtatcttcttcagctgtgatcaacattattgataactgcagttgcctcagtggtctacactgtaggagtttgtggcagcgtagtggcagggtaagttgtatggttcttggtgataagggctttaggggtcttcctgtttatgtttacccacagtagagagactcagctgaggggatccctcttgctgtctggtttgacatgtcccataggcagccatagtggtgctgtactacaagacacaggtactcagagtggctgtagagctgagggcctgggctcaatgtcttgtttcattactataacacctgtgacattgatgcaggttcattctctgaggtgcaggtgggtgctgcagtcccactaagctagggtggtgactcttaggcactcctcagtagcttgaaaccaagagaacagggaggtagttgtgactctggtcctggggatcaaggtgtaatactgacatagctctagggaagaattggtgttctacaggcttagtacttatggatccagccatagctgcaatttagatcctggaagcagtggaggacagagacattttgagcactgagagagggggtactgtgtagtggtggctccggaccctggagtgctaggacatagccgtggccaaagccctgcaaggttggctgcatcagcagcaataacccaggaatgttggggcacggctgtagcttggactccggggagtagggggcaatacaaaggtatcttcattgcccatggaggtgagatgcctcagcagttcagattccaaaaggcttgtacagattcagggaagcaaggtgctgaagctcttcagcccagaggacaaggtaacccagctcagccaaggctctttttccctggggggaagggtgcctgttaactcctgttccagggaatacagctgctctgctggactggggtccaagcattagattgcttcaggcactgagcgggtattgctgttcttccagcttggcaacagtgtctctgctgggtgggagcacatgattcttagggactgagtgctgcatgggcttggatgatggaattgtgactgatcctctggactaaagctcaaattcctgagggacaggacactgggttggtgtactagtccattctcaaactgctatgaagaaatccctaggactgggtaatttataaaggaaagaggtttaattgacttacagttctgcattgctggggaggcctcaggaaacttacaatcatggcagaaggcagaggagaagcagacaccttcttcacagggtggcaggatggagtgagtgcaagcaggcaaaatgccagaagcttataaaaccatcaggcctcacaaactcactcattatcatgaaaaaagcatgggggaaccgcccctacgatccaattacctccaccttgtccctcccttgacacatgaggattacaattcaagatgagattttgggtggggacacaaccaaatcatatcaattgatttaggtactgaggggctgtggctgctttctggctcaagtatggcttcttggctgggcaggagtgtctggtcctttggtggcagggcaccacatgggctcaggcactgaggttacactgctctgtggggtcaaaggctaaatttccgaggagtggggcagctggttggttcagttgctgggggagtagctgctctcctgagcctaggctctgtgtagacaggggtggagctcagcagtgactgggatgcgggggagggattctctcctaggcaatgtttcccaaggagaaggagctgcagcagtttaactggggtctggtacttttccctgtacgagaatgtggtgtaatggtagtagagtctcagggatgaaagaatgcagtggctacttgttcctggggcagggcatactctatcaagggctccggtttcaagattgtgatgcacagtagcagcacggaccacagggggtggggtgcaatgtgagatcttttagagtagtgcagccatgtgaactccaggaaacaccctaagctgggcttagaacctgtgaacactgcagggtttttcagtaacaaagattataggtatccactgtggtgatgaaggttgctaggggcctcctccttcctgtttccatcatggcagaaatacttcctgtttctgagctgattttagctgggggcatgagtggcagagtcaaggctttctcgtcttatctctatgcagcccttctgagtttctgtgatccacaggggctcttcacggacctactctacttcagtgctttcctttagttgctctgaccaaaatatagttattcatttgttgttttggtaactgttttggtggagagggatgagagttaggcacctctagtgagacatcttgatgatgtctcaaaaactctatcttcctattgttctattttcaagtttgctaattccttgtgacatattttttctgctaagttcctgccggaagttttattatgattattatatatttcatttccaaaattttaatttccttattcatgttttctatttctttagttactgaaattttctattctttttttttattatactttaagttctggggtacatgtgcagaaggtggaggtttgttacataggtatacatgtgccatggtggtttgctgcacccatcaacagtcatctacattaggtgtttctcctaatgttatccctcccctagccccccaccccccgacaggccccggtgtgatattctcctccctgtgtccaagtgttctcattgttcaactcccacttatgagtgagaacatgtggtgtttggttttctgttcttgcgttagtttgctgagaaagatggtttccagtttcatccatgttcctgcaaaggacatgaactcatcctttcttatggctgcatagtattccatggcgtatatgtgccacattttctttatccagtctatcattgatgggcatttgggttggttccaagtctttgctattgttaacagtgccacaataaacatatgtgtacatgtgtctttatgatagaatgatttataatcctttgggtatatacccagtaatgggattgctgggttaaatagtatttctagtactagatccttgaggatcaccacactgtcttccacaatggttgaactaatttacactcccacccacagtgtaaaagtgttcctatttctccacatcctctccagcatctgttgaggatatttgtatttgcttgttgaagaacttttgttgacaaataattctaacattctgtcatctcagcattgcgcctctttttttttttcttttctttttttttttttttttggtcaatcaagttgtgatttcctgtctcttgctatgacaagagctattttattatatcttgtacattttggctggtatgttgagagactctggatcctagttcagtcttttatttcaacaggcagttacactgtttagcttaaccatgtaaatactgatctaattttctggccaacagttttaatgacagtttaattttgagatactatttttatctgcttaattggcctgattctattaggtcttttgctaatccttcttggtgccaccagtgaggaccaaaagtgcttccccaggcagggttatctccattagctaggctctggaagagcacttttcctggccccttgttttctgtgggttctttcctgattcctgcctcagcattcaggcatcatgggttgctcagtgtctggtgtaagttgtaaaggttggggaactttagtttccaggcacttcccttggcctcttgtaggcaggattccatttcaataaagggaggaagggtcctgcctgagctgctttttcgtactgatttgggaattataagatgcccatgctgtatctctttgtgctggtgtgggagttggagcaagaactggaagatgttgaggcacagtgttttccttcaatcttgcaatccttaaccagtctaccttcctctttccacatctcagagtcctcctatggttgtctgttgtgttatctttaaggtttataattgtacgtagaggagaggaacaaggaatgatgagtctatgccatctcatccagactgcctttcaagggtatctttctttctatagctcaagttcttattactctctaatttaaattattcagttaattcccatcactctcaagtaaaatcaatacttcttaatctgaccttatcaattaggaccctgtgctacatgtaacagaaaccacaatccaaataataattaatgaaacctctatcttggcttatatctgtaaagctcagagtcttcaagggaggcctcatgccaggcttaaaccatatcaccagaatccatcactagtctgctttttctgattggctctctcatagtgtttataaaatatttgccacatttttcttggggtcagcttattcatgttcataccccaaagcaagaaaaatatatgtagaccctaacacatcccacccttacacaccaagcaagaaggctaaatgtcatgggtttcatgaggtaactttctccatatttgaactctaagtatgtggtggggtcagggaaggcatcttcttactcctgtttcctgaagagtgtgtagtagtcaatatttcctgaagcacatgggccgtaaggaagtaaaaattcagttcctgttatttaaagaaagggaaaatgggtccatcaggaccaaaaaaaaaatcctgcaaatgtaattacagtggtttacaagtactgccttcatctctacttgtttgctttgctactttccactcgtccagtgtatctttttgtgctcccaagaaaccattgagaagcactttcagatttttagatgtatcatctttttccaccttgaagactatggtcatgctactctctttgcttgaaacacccaactccattcttcttcagtactatggtttgaatttatccccaaaattcatgtgttggtaacttaatccttaatgcaatagtgttgaggtttttaaagagatgattaagtcatgagggctctgcccttacaaatagattaatgcagttatcaagggataggttagttctcacaggattgggatcctaataaaagggtaagctcagccccttcccttgttcctctttctcctgcatgtgctgtctcacccttcaaccttttgctgtgcaataatgtagcaagaagggcctcaccagatgcaggtcccttggccttggaatttccagcctgtagaactgtaagaaatatttgttctttataaatatttatttatatttataaacagaatacctagtctcaggtattctgttacctcagcaaaagacaaactaagaccaacaactgatactgagtagcgagactgttgttataacaaatacctgaaaatgtggacacagctttggagttgggtaatggctacgggctagaagaatttgaatgagcaagctagaaaaagtctagatcatcatgaatggagtgttaagggcaattctggtgagggcttagaaaaagacaagaactttcaacagcttaccaaccaaaaagagtccaggaccagatggattcacagctgaattctaccagaggtacaaggaggaactggtaccattccttctgaaactattccgatcaatagaaaaagagggaatcctccgtaactcattttgtgaggccagcatcatcctgataccaaagacgggcagagacaaaaccaaaaaagagaattttagaccaatatccttgatgaacattgatgcaaaaatcctcaatgaaatactggcaaaccaaatccagcagcacatcaaaaaacttacccaccatgatcaagtgggcttcatccctgggatgcaaggctggttcaatatacgcaaatcaataaatgtaatccagcatataaacagaaccaatgacaaaaaccacgactatctcaatagatacagaaaaggcctttgacaaaattcaacaacgcttcatgctaaaaactctcaataaattaggtgttgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaaatcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaaaaacaggcaaacagagagccaaatcatgagtgaactcccattcacaattgcttcaaagagaataaaatacctaggaatccaacttacaagggacgtgaaggacctcttcaaggagaactacaaaccactgctcaatgaagtaaaagaggatacaaacaaatggaagaacattccatgctcgtgggtaggaagaatcaatatcgtgaaaatggccatactgcccaaggtaatttatagcttcaatgccatccctatcaagctaccaatgactttcttcacagaattggaaaaaaccactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgctgcgtatctacaacgatctgatctttgacaaacctgagaaaaacaagcaatggggaaaggattccctatttaataaatggtgctgggaaaactggctagccatatgtagaaagctgaaactggatccctttcttacaccttatacaaaaatgaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaaaggctaatatccagaatctacaatgaactcaaatttacaagaaaaaaacaaacaaccccatcaaaaagtgggcaaaggatatgaacagacacttctcaaaagaagacatttatgcagccaaaagacatatgaaaaaatgctcatcatcactggccatcagagaaatgcaaatcaaaaccacaatgagataccatctcacaccagttagaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgttcatttcatcactattcacaatagcaaagacttggaaccaacccaaatgtccgacaatggtagactggattaagaaaatgtggcacatatacaccatggaatactatgcagccataaaaatgatgagttcatgtcctttgtagagacatggatgaaattggaaatcatcattctcggtaaactatcgcaaggacaaaaaaccaaacaccgcatgttctcactcatagatgggaattgaacaatgagagcacatggacacaggaaggggaacatcacactctgggggctgttgtggggtagggggaagggggagggatagcattaggagatatacctaatgctaaatgacgagttaatgggtgcagcacaccagcatggcacatgtatacatacgtaactaacctgcacattgtgcacgtgtaccctaaaacttaaagtataataataataaaaaaattaaattaaattaaattaaattaaaagaaaaaagaaaaagacaagaactgtagcgagagcctacattttcttaggagttacttaagtggttgagatcagagtattggtagaaatttaaacagtaaaggctactctgacaaggtcttagttgtaaattaggaatagggtattgaaaaatggagtaaataccattctttttataaagttgcaaagaatatggtggaattatgtctgtgtccttggactttgcggaaggcaacactttagagggatgaactaggacatctgtcagaagaaatctttaagcagcaaagtgtttacagagctacgtgacttcttttggttccttatagtaaaatgagagaagagagaaatgattaaagatggaatttgtaattaaaaaggaaacagaatgaaaagatttagaaaactctcagagcctagccaagtaaagcatgtttgagagagaatattaatagtgtgacaaaggtgtttgctaaagagatttatatggctagaaaaacaccaggttctgtttgtcaagacaatgggagaatgatcctaaggcatttcaggtgtgcagaatgcaacagctgtagggccatggcgatctactcctaaatttaaatggatgttgcgaagaacctgtgagccaagacagaggcttgtcacagggatggtgccaccccggagagcctccactgaggaaatgtccagcagagccataggagtgaggccactacataaactccttactctcataatgtttagtggagccatggaagtgaagtagaccctgtgaccccagaactacagagcaaccaatgtgcaactgcatcctgggagagctgcagccataagactctaacccattagtgctgctgggtggactgagccaaacaaaaccctagggacagggcttcatgaggatgtggggtcccactgccttcccattgtgcccagatgtgagacaagagctcaacacagattattgtctagttttaagacatgatatggtttttgttgttgggtttagtactgacttggggcctgtgatttctctttttgtgcctctctctctctcttttaaaatgggaatgtatatcctatgcctgcccccccattgtgttttggaagcatgtaacttttttgatttcataggctcacagatggaggggaatttgcctgaagataaatcacgccttgagtatgacccatatctgatttagatgaggctctggattttgaacttttgaggtgatgctggaaccagttaagactagggtgagataaaaagaatttattttgtgtgtgagaatgacatatgttttccaagccagggggcagcatgctattgtttgaatgtgtcactaaatgcaaaggtgttgagaaaggggacctttaaaaagtgattatgtcataagggctctgctttcacgagtaggttaatgccatcattgcaggagtgggttagttgtcatgggaatgggtttctgataaacagacaccctcctctgtctctcatgtttgtgctgtcttgcccttccaccttccactacggtatgatgcagcaagaaggctctcgctgtatgtgggccccttgaccttcgactttatagcctccagaactgtaataaataaatctctgttctttattacccagtctcaaattttctgttattatcagcacaaaacagactagacatgcagccattttccctctagacacatgcacacacacctatgacctatgtcttgtattgtttcttatgcttctgcattcatttcaatacttgctctgcaactctctcttacactcaaaactaggtgatgccctactgattttacagcctcctttacttctttcaccatcacacttattataccctactgcagtggcctggttttagctgtgtatcccactaacttacaagaaaagaattgtgtcttaatcacaacttgacccttattacctaacaaagagcctcttgagtgatccactttaaaaaactctaggcgatcatatcatgctataagtacatgaagaaaagaacaattataatgtttaggtaaacaaggaggagcctttgtagtaggtgaaccttgaaaaaggagtagaaattttccaggtcttagtttcaagaaggcatttcaggcagtagaaaggtatttcatggagacaggcaagtataagagatataccacctgttaaaatgaaactgaacagatccccgtccccatgggcgttatccatctgtgccttcaaatccatgctgaggctgcttctgcaagcttaagaaattggtattttgcagatccctggagtccacatgacattgtctggccttgtttgttactgctcttttttcagtgtgtaggaatgaagaatgagtgccaataaatctgaatgtcaaaagtcaaatacaaatgtcaaggccattccacatcactggttgttttgaattctgagcccaatttttgcaggctactatggtggggagaaccacttggctatgtctccatttacttatcaaaggctactccaggcataacagacctaggctgcaggcaaatggccttcttatgccatacaagcacagactaactcatcaaatgaaaaagaatagagtttgaaattcctttatgagttttaagaatatttcctgtgagagaaattttgaaagctgctcaattaaaagcaactgtacttcatatattttattttattgtgttgttggcttcatttaggttgaaattagggaatctagcattgttattggtgtttacttttttgagaagtagagcaactcaaattattcagcaggagcagaagggtttggttgatcctatgttgtatttatgccttatatggtattttaagatcttatacaggtaaatagaatcacataaaggtaagaaactaccggagctgtggctcatgcctgtaatcccagcattttgggaggccaaggtgggcagatcacctgaggtcaggagttcgagactagcctcaccaacatggtgaaacaccatctctactaaaaatacaaaaattacctgggcatggtggtgcatgtccgtagtcccagctactcgggaggctgaggcaggagaatcgcttgaacccaggaggaggaggttgcagtgagccaagactgcaccactgcatgccagcctgggtgacagagtgagactccgtctcaaaaaaattaaaaaatgaagaaaaaataatgaaaagagaataaactatctcctttgagaagacaaaggagaaaataagatatattaagctccgagtttgaatcaggaacttaaaaaatatacatatgttattttatttaaccctcactggaagcatgcatatttgcccaatgcctaactttatcaaatgttaatactctgtctcaaaaaaaaaattttttttttaaatcataccctatgtggtcttttgtgcctggcttatttcacttagggtaacgtattaaatattcacctatgtcatattacatattattctttgtattgcaaaataatatcctaatgtatgtatacgctacatatttatcagtttataaacatttgggtcattctcaaatttgtgctatgaacattcatgtacaagttttcatgtgtttatgtttttatttattttgaatatatatactcaaaaggaatagagtgctgggtcatctggcaactccatgtttatcattttgaagaactgtgaagattttacatttccaccagaaatatatgagaattcaattttcttcatattcttaccaacactttttgtcttcttgttattttagtcattataatattcaagaaatggtatctcactagggttttaatttgcattccaataatgtctaatgatgttgaccatcttttcatatgtttgatgaccattttaaaatcttctatggagcaatagctattcaaataatgtgtccatttttaaatgagttctttacatttttattattaaagttgtaagtgttctttatatactcagtggacaagtgtcatattagaaataaaatttgcaaatattttatctcactctatgtatcttctttttatattatttgaagtttattttgcctgatattagtagagctacttgagctctattttggttgatgtttgcatggcatatcatttttctatccttttaccttcaagatatttgatacatataatctgaatctgaagtatatctcttgtagatagcataaagttggatcatttttaagtccattctgctaatatctgccttttattggaatgtttgacacatttacatttaatgtaattgttgacaagtcaggatttacttctgcctctttgctctttgttttcaggcattatgggtctttctttactccctattcttctatcacagccttccttagtattaaatgaatatattaaaataccattttaattcccttttttttttaacgatgtaattttaaattttatttttgtagtggtttccctgtggattacaatgaacattttcacttaaaacaatgtaggaattcaataaacatttttacttaaaacaatctaggattgataacaacttagtttcagtggtagagacaatctttgctcatggatagttccattttctcctccttttgcactgttatcattagcatatgcatatgactttatgcatcataatataatcaatgaagtttttatgtattgcttaatgtagctgccctttaaatcaaatgggaaagaaaggggcttacaaactgtattgtctctaatatttatttatgtagttatctttatgggtaccctgtttcttcatgtgaacttagggtactgtccagtgctttttctatttcttcattttagcctgaaggacaccctttggtatttcttgtagggcaggtctgctattaattaatattctctttatttctctcatagacatacctttacttctccttcagttttgaaggacagtttcgctattggtttttttctttcaacagtttgaatatgtcatcccaccacatcgtggcttctatggtatctaataggaagcctgctactaatctcgttggaaatcatatgcgatgactccttttttcgatacctttacaattctctcattgtatgtgtgttttgacagtttaattatgatgggtctaagttattatgtcttttagtttatcttacttggaggtcattgagcctcttggatgtatgaattaatatttgttaacaaatttggggaattttcagccataatttcttcaagtattctttttgccttattttctttctcatccttctaggacttccattatgcatatgtcagtgtgattgatggtaccacatagtctttttgaggctttgttcccttttatttatctttttttatttctgtttctcaaaccataaaatctcaatttagctatcataaattcactgtttttttccttctgcctgcttaaatctgtttttgaacccctctagtgaacttatttcaattattgcccatttcaatgacacattttatttatttattttaaaaataatttctatataattattaatattctctgtttaaggtattattctcatattttatttaattatttagatatgaagtcctgtagtttgttcaacatattatgatacgttaaagtatgtttaactgacttaaagtttttttttattaacatcaatatatgtatgggcatccttggagagactttaacttactgctgtgctttccttttccccttcctgcccccacatgggtttacttttatgtttctttgtgtatcccataatttttattgaaagctgaacaatttaagtaacgtaatgtgacagctctgaaaatcagattcacctccacttgccaaagctcttatttgattactgatgtttattgctgttttttttttggtttttttttcatttttggtaactttcctggaataattctgtaaagtctgtattccttatcatgtgcagccactgacatctcttttccattaacttagtggtccactgatttctacagagattgccttaaatatcttcatcaagtagaactctcttcctttgccaaatattcacatttgtgctggggcaagccttcagtgctccagcagtttacaactctgtaattaccttcacttcttggtttttcaggattcaagatcagacagaggtgagagagtagggcctgctgggatctttcctacccttgtgcacaactctgttcatgcgtataacattgtgaatccctgggaatatgtagagattttcaaagcccagtaggaaatattattccccatattttcatcttaagctttttgacaagcttcttgtttgccccaacttgctttgctgcctcaggcatcagccacgttaaacaattgctgctgattgcttcaacaaactctcttatgatagggctttcctccctgaatgagctttaagtcaggtcagataaagtttaaaaaagtgacagttcttcagtttggaacttctgaagatctccaaactctacctcttccagtgtttagtggacttctagtttttactgcttttatggctgctagattgttaaattttaaagttcacacagagctggggaaagggggatggaaatagagcttaaaatgatacaaagcttgctggttttgttgttgtcatttttaccaaggttctgccttttttcttctataaacactccttagattgttacaagcctttggtttatttctagagttcttaaaaaaagttgattttttttacaaatgttacctatctttcattgattttatggagagacagatgtttggagggacttactttatcatctggaagtaattagatgtttggagggacttactttatcatctggaagtactcttcttcattgataggtcttaaaagttttggcatttcagtacaacatagatttatgtgaatttatctttcattattctgctgggtactcaaagggaattttaatttgtatctttaattctgaaaaattttcaccagttttatcttcaattattacgtctttgttattccttctgttcaagactttgagtcttattttgtttcctgttggagcttttaatctattcttcatctctattaggtgttatttcaatgttttttgtcttggtcttgctactgcattctgagttaaattttaaatattgtcttccagtttaacaaactcttctatattgtgactagtttttgaaatttttaggatgatttaattatttttttattttaattgagggtttttatttatttatttatttttttgacggagttttgctcttgtagcccaggctggagtgcaatggcatgccctcagctcaccgcaacctccacctcctgagttcaagccattctcctgcctcagcctcctgagtagctgggattttagacatgtgccacaacgcccagctaattttttgtatttttagtagagatggggtttctccatgttgtttaggctggtccgaactcccaacctcaggtgatccgcccacctcggcgtcccaaagtgctgggattacaggcataagccaccacagaggttttttgtttgtttgtttttttaatcctaccaataaactcagagttttcttctctctctttttttatttttaacaatctcttgggttttttattttggtttttgaaaatgaagatttaaaaaaaatttctctcctgaaacattcgtctgtaagttttaaaatgttgatcattccatctggagtaattcttctgtgtattgtttgtgatggttgtaattttaacattaaatttcacatgaattttggaatttggatttgctggctcatttttgagtgggagtttgttgtgtttcattttacttttcctctctgtttatgcttacttttttctccctaccatttcttggctcacattaaataatgaatcactataatgtaattggacgtatctgtgctgagacagtattagggagagggtagatatggtcacccagtcaggaagcatcttattgtctcattttaagtctctggctgtcatctccctaggcctgcagctaccaggaactagaaatctgaaaagtgttcagtgacatctctctacccccttatttattctggggagatttaaaacttaagccttctcagatccaggtgtcattcagaataaggttatgttgcaatagcttataaccctaacatctctgtggcattaaaaaacaacaacgaagtttcatttctcactaatctttaatgtctgttgtgggtcctgtggctatgtcttatcatcacttttattctgtgactgagatagatgagattgtctcttcctggatcaaaagcatatgggaaaactgatcagtggcttctaaagcttcttccacaaggcatcatatcatttttgctcacattccatagactcgaacaagtcatgaggccaagcctaacattaataccacaataaagtagattctgccccactagagggttaatattttatattaaagtataatatggtctaccaaattctctttcacttattttttttacctgtaatagtgtaacctttagctaccactgtctgctttgattccctcaaactgcctgaactattgcttcagctgtgaacaacactttctatttctattctattctgtgtacttgttttcttgattttagcccaattatctctctgattttctatttttctctttgtgtctcattgttctatgtttggagcataggaaggtgcctcagataataaattaaatatcctatctcattcataatggcatcaattttttttggtggaagaaaaacaaacttcacaaatccataattaaatctcctctctctcccacaaatcaccttttggaatcagttttagtatcagactagggaaccaacatcctctgtgtctggtatgagatgcaatctttatatttctttaaggttttggtgttaattgatccagtagaatttttatgtaaccaaaatttattccttggcctgaaatgttctctaattagttactataaactggtgcttattcagccgagctgtgcaattttgggacttttgggttaataaaagcctaatctgctcatttgtttacactgtttactccctaaaggcttatgctttgtgactgaaaacaatgcttaataagcagaagaaagcatgttaattgtaggcactgccatgctgctgtgtacctaagagctgggcttggctgcagctcaaacaggtcttgggtagaactaaccaagttgccctcaagcttaacttccaattgtcacaaaattcatcttgggcttagagatgaattttaaatacatcgaagagtaaaatgctctgttaccagagtgggtcagtggagctcagctaccatcgatctacactctaactctcttcctccatcaacctttacatcctctaatggaggaatgtctcccatatgaaatagtggccactcacccaaatgtaatattggtgacagacaaagggaaactaagctctaacctctctccccaccaaaagttcacatttcttcagtcaaatcatcatgtggacagaaatcaatttcttctctatgctgtcactgagaaagagggaatatataaaactcacgtataaaaatacagaagtaaaatgaagatctctatgttaagtgagtactatccagaataattgatttccattactggatatcttcaaataaatgattgatggtaatttgatatcacaaaagagaaagcagtattttttataaaaaagctttattggtataacagaggtataatgacattttttaaaaagttacacatgtaatgtatataaccttaatgagtctggacacttgtgatactgttaccacaaccaaggtgtgaaacatatcatcaagaccacagtttttgtgtatgtgtgcacattcatgacaggatatgtgttacagagctaatgtctttattttaaaaagctttattcatttggattttattccttactattatattctttattcaacagttgtctttccatctcatctctcctgattcttccccatgctttaaaaaatgttaatgtcttcttgagactgtcaaaaacaacattacaacaaatttctttatagatctaattggcttttataggtgatacatgaatcagggcagccttcattctacaaaactgaacaagtgttcttctgggcaggggcaaaacactgggttttgaaaggtgaaaagtaggaaatagaaaaatggaaatctagtaagcatcatattacctcaggttactttttttaaaggggtaaagcagaagagacttccttattaggattactgaggtaaactggaatctcttgttttcaggaaagattgttttgtttggggatctatctgctttcttaaattttcattttaattatgtggcatttagcatgagtgactccattttggtttggtctggtcgtttagggcctagtgcaggagttcagtctgaaacaatggcctcccataatcttgtttaacaattctaaaagaaggtcgttcctttaactctattcctctctgtggtttcatccctctcctttaccaatcgattcatatttacttttgtatgttctcaaaggcaagttaaataatactgcatactgaagtctgttcagtgtccccacaatcataataaaatgtctaagacagacttatgagcttctcaaactgtgttgtgggtgtacttttaggctcatgtgagatcatgaatatggtgcattctcctgaagtatcaattttactcagtactgaaaacattattctatcattaaaacaaacacaactagattagagagtatattgcaaaatctccatgaacttaatactaaaataagagtctgaaagccgactggtaccccagattgtcaatcagctcctattggaagcctgtcaagtccaccatagagcagcagccaaaccatttcatgggagagaacgaggactctgcagcgaagtctgaaagtgctgcagccctctggaccctgtggactctcaaaactaatcaaatggaatgtccatccaagacaaagccccgcaccaatgtgaaattgttgagagaaaaccaaaatttatcaaatagctacaatagaagcaaaggaaataaagtggtaaagagagagagagggggaggcaaagaaaaggaggaacaaaagcagcattaccacagtgaatgtgaattttaaaattattttctcatttattattttgcaaaaatgacaggagagggagccctagagccataatgctagaaaactatcctgacccttcctctttcctaaaagtacaaagaaactccaaagaagaaaagaggagaaagatgaggaggaggaggaagagaggagaggaataggggtaaaaataaatcttggtcaactcttatacaaacttattataaattcttacagggaaggagaatgaaaacagaatgatgcagacaaggaaattatgccataaagctagtcccaaaacaaatgaaaactacaacctaatattttttaaaaatagctaaaataagaagctatgaaaaaaagatgtataccagaattagaaaaactctgaaaagaggcaattagaaaaattaagatctaaaaagagaagtaacaggacaaatttagaaatgaaaatgaacctttttacaatcagtcttcatttttactccattgcgttcgacactgttgttctgaaagtctttcctgctctggactctggaagatgttagtccttctaattctcctgcagctactgcttcctgctctaattcatggctcttcatcactgccatagaaatgggacgtttcctatggctctctctgggccacatctttcagttaacttggcccagtggctgcaacaacttttaaagtttataaataactttaaatatggctgcatttcaaataaacccctcacttcttgacctgctccatacttgactatccaggtgcctttgggatgtctcactggcatttcaggtgggtcatgtccaaagtcacctactcagtgcttaaatctacctctcatatacaatttcataatttggaaaacaatgttttttttctgtcactcagattcaaaactccagaagcatccatcactgctttcttctttgtcatgttcattatatcaaatgtccttgtttgctcatgtctgcccccaaagtacctcgaatctgttctctcctttaactcttcactgccactccctcaacaccactctctacttgcaataaataactgttttttgccttctctgacttcattttgtctcatctgctagtgatgttgtcaaactgatctcaattggtagatcggagttgtcttctaggggagtttatgaatgtaaacaaaactgtgaatgtggcctcctgaagttgcatatttgacctggctctgtcttcttcagggcaacagattctcaacctggttttgttgttagtacagttgaaagaattaattttaagaaaaacaagtcagaagaaattacagtgcagtaactagtaaaataatcatgactacattaaaatatttttaaatacccttaaaatggttcaaggtattatcctctagaagtgtattgctatttattgccttttcaatactcttttgtatacctgaggcaatgtctttgagaacctacttgaaaaaaagtgtaacactgttttcctcttactcacagtaccttgtaccctgatatttgtaacatcacaaaacccacagagttaggggctgaccaaatatacacagtaagttatagtattgggtaaatgaaacaatcctgcaacaaaagattcttcagttccaatacagaagaataaaggaaacacaatttaattttgagaaagcattaccaggttgacatgtatataaggtggcacacaagaaactataaactctggacagaatcttacacaaatctatacagcagtcaaagaaagaacaatagaaacttctcttatctccttgagagataaatagatgagccctgtcatctgctctatagttgtgagatagcacagagctaatttgtaggtttacagttccaaggggaagaaggccagaaaactgaatcaaaaggactatcttgtttgggggtttattaagtttacaaggaaacaccccaaaggaaaaaagcgtgagtatgaagccacttctctcctcaaagaaaattttataatttatttttacagttgcaactacaatcacttgtaaagacaaatcccagattccttagaaactagaagcatagtaatgaagagttctcgaaacatctgcaagctactgtgtataaatggaaaatcactgggctatagagagacggtcagattttttgtgtgtggaatttttaatgcattttgtaatctcacatcaacttgatttttactcacatttcccactcctacatccttatctcggaccccttgggatatagagaaggactggctgggctggagtcagttggaatgcagacagtggtaggtcacacagaggctctgcaggtgactgggagatactcaaggttcataggataattggatgtcagtcattctgatagtggaattcaatgatatagaagaggattatttagacaatatgtagtcaagcagtctgccaataatttattgagtacctgctatatgccaggggctagataatttccaagaacagagtatatcagcatgatagagttctaacaaaagatgctgagacttattggtgcggctgtatatctggagaagagctccggtgtctagaaaatgagagaggtaaagagattttaccctaggctgggtgcggtggctcacacctgtaatcctagcactttgagaggccaaggcgggcggatcaccgaagtcaggagttcaaaccagcctggccaatgcggtgaaaccccatctctactaaaaatacaaaaactagctgggcatgttggcttgtaccagtaatcccagctactcaggaggctgaggcaggagagtcacttgaaccggggagtcagaggttgcagtgaggtgagattgcgccattgcactccagcctgggtgacaagagcgaaattccgtctcaaaaaaaaaaaaaaaagacatttcagtctaacgtaaaggaaatctctctagaaactggagtattatgtaagagatggtcttttgagaaatacaggcagaagccatgtagcatttgttgacaacactgatgggggattcgtgcaccaggcccaatggtgaactctagaatctctaggtctctagggttccttctaattcaagaagccaagtgagacactgtagcagacagtgtctccaggcagggtactgagcaaagaggatagtgaaaagggcagtgaaacatcggcctttttcactggcaacttcaagactcactgcctacaatgtaagtattcctcgtattccctaacaacagttcaactggaagagtggtttctgtgaatccctttgactttttatcttgccttggtcctggctccatggaggtccactgtccaagaatagaagagctggacccgccatgatacacccttcgtcatgttggccatgtctggataggtcccttgacttcagtgtctttcttaaggttcctgcctttggttctctttgcttcctctttggatttatagccggtttctgactctcttgtgcttgaatcttatttctcggttttctgtctctatcgccttctagactattacttgtgatttaaaaaactatatttgctagctatctgaaaatcaagttaacattagcaaaatgttttagcaatgctctgggtttctacatctttacttttctgcggaaggtgagagacatcttacatttggttaggatatttcttagtttcccttgtgatttttggttttaacaaatgagcaagccccagggtgattattataacaattatttttacctacgggcaagaaagggaaacatattcaaccactaacattgacttagctttatttttaagcatcccaatcattagcaccattcattcatttaacaaatattgaactctgttttacagtaatttactgtgctgaatgttatagggaatgagagtgtgcatattacatgttaatgatattgcctagcatttagtaggtgcttaattaatgttagtacatttggctgttgatgatgacaaaaatgatgaaagtggcatacatagtattaatgaagtctattttctgtattataatatttggaagttataggagattagcaaacaagctgcaaagtaccaaataagatatattaaagcaagagttcagtctcaaatgctagtgaaggaggcatttctaaatgtgactaggagtctcccaatttgaattttcacttcccttaaggtgacctgagcagaatccaaatcctttgacttgatgtgggtggacagctggtgcacagaggagctaggggcacaattgagctggaaaggctgttaactgaagtatcctaagactgcctaattaaggggaagagatctggggagctggaaggtgggaaagaattgaattcttctttatcaaagggcaaaggcaaggttatgaaagtaaatgagtattgtgttcagatagagaaatagtggtatagtgaatgcagcaaagatacttcaaatgactgagtcctgggaaaaggagcatgtgatggaacatgcctattaggcagactagtgtgttccgctagagaaaagttgcacttcgaagatgtggccactgtctggaggtacatattttaaaccactgtatccatatcagtccaaccaccatgtttaatctcaggaatctggagagatttatccatggtatcgggatcagtaagcactggaaattaagagcgtaagactgaagtaactatgaaaacttatagttgaagtggtcactccatcagcttccttatgtgttggcaagatagtgttagaaaaacatctttctttttctttctgtcttcaaaaaatgagctgacacattccatctggaatgtgtcattaaggccagtagcagattgccaagccctccaacaatgaattacagccatcaagctgtggcattggagaagtaagggttaatcattgtgtcattggtatccacagagttcataattttggactttgtgcaaatggaaaattgtaatcttcagctgccttttgccaggctacagaatggcagcagagtccaatgtgatagacatattagtggtaaaaagcctgtttacctggtgcaaacagggcttatctttcaagacactatttgaagagtacgcagaatttcttgggagaggaatattctggaggatggatatattcacttgcccctgtggcatttgttttctccttgtaatgtctgtgtgatgtgatggtaaattcagaatatctgttccaatagacacattcaatgtaacactcaacatgatccattgctatcccatgctttgctttcttcgggttcctttaaattaccaaagtctcttgtatgtgagctgctttgaccagttttcattttaggaatgagaggaaagcatctcttaccaaaaaagtaggaaaattccaccattagttacccatttaatttgtttcaaatagcatgtgaaaaacagcagtcatctaggtaaaagaatgggctgaatccactagaggtgcgtagtatgagttttttaaccaaattcctttactctaatacttttgtgagatcagatatagttaaagaatgtttgattgggtgctaggaaagtgagagaaaacagagctcattcacgacagagagaggaggccctggtgtgttgccacaaatgagtagcatcttggataaatgcaaatgtctggaagtcaggggagagtggatattagcagaaaatgaatgtgcaaaagggtttgaaatatttcaaactttataaatcagcttgaggctactctgcatgatctaacttttttgaaaacaaacatgctgatcaagggggtcaaattggtgagctcaggtttaatggactaaaactgagaaactaaaaattacagcaactgccaagaaccttgcatatccttatcagtttatgatatttactcagatatattgatttcaagacaaaaatatatctttcaaattgtgtctacataaaatatcagggttaatgtagaagaacaggacaacccatggagtagtactatttaccaggccctttatttttattttttttaaattttttgagacaagatctcgctctgtcacccaggctggagtgcagtggcctgatcacggctcactgaagctttgatctcctgggctccaaccatctgccccactcagcctcctaagtagctgggactacaggcacgcaccaccaagcccagctaattttcggtttttgattatttttgttttgtttttatggtagggacaaggctttgccattttgcccaggctggtctcaaaatcctgggctcaaatgattcacctgtcttggctcccagagtgttgggattacagatgtaaacatcgcacccagcctccctaggttccttattttgtgattgtgttgaatgtttactacaatcctctgaactaacacaaagattttatgatgtagaaaattctggtttaaagagtatcaaagaaaccgtctgaggctatgtgaatcttaagggaggaattttgcattcagaactctgtgaggactccagacccctatacttcctgtagatgatcctcccctccagtaaaggcacctgtgttgaatgagtgcagaccattcaagggattcggttgtagtatgacaggggcagtagaaaactttatctgtggatgtgagagtcggtttagaagtttattttggaaatgtgtggtcaatattcttttaaattgcctgtaaatgtttctgcgcttatttgtgtgggactctaaatgacagaatagatagggaaatctagttacccatctatctcctaataaatcattgaagacaattgcatcaacagaagtatgtgtatttcatctttgctgaagggcacatttaaaaaaatgttagttcaataatctcatttgtaaatctcagaaatcttgtgatgtataatttttcaccttaaagagtttctttttctttcattcattcatttttttgactttatgagagaatcagaatctctttgacatcatttgcagaacattgcagatgaataaaagggtggtgattgagttattccggtgttgaggaaagagtgtgggctttcaagtcagacatgcccatgatgaagcgtaaatatgtattttgagttataaaatgaagacaacaatacttctcacaggatcgtggggaaaattaaatgagataatggctacaaaaaatatttagctcaataatttgaacacacgaagtagtccctccttatccatggcttcactttacggttttagttccccaaggtcaaccatagtccaaaaatattaagtggacagttccaggcataaacaatttataagttttaaattgtgtactgttctgaatactgtgatgaaatttcacaccattatgctttgtccctttgtccagcacatccgcgccatccgtgctcccagcccaccagtcacttagtagctgtttcacttatcagatcaaccatcacagtggcactgtgctagtgtccaagtaacccttgttttacttaatggccccaaagtgcaagagtggtgatgctgtcaatttgcacccgccaaagagaaactgcaaagtgcttcctttaagtgaaaaggtgaaacttctggacttaataaggaaagaaaaaattatatgctgacattgctaagatctatggtaagaatgaatcttctaagtgaaattctgaagaaggcaaaagaaattcatgctaattttgctgtcacacatcaagctgcaaaggttttggctacaatgcatgataagggcttaattaagatggaaaaggcattgcatttgtgggtggaagacatgaacagaaatgtatttcgaacgacagcaatcaggttcagtactgttcgtggtttctggcatccacagggggtcgaggataaaagggggccactatagtaagtgctcaataaatgctagccacaaaatcattatcattcttattgctataatcacacatgagaaaatcaattatcttcttcaggccttggattccaatcttgtaaagtgaggtttaaatgagaatgcatatgtgaagcatttgccttacaacacaaagccttaataagtgccagtgactcttctccatccgttttcatccagacaccactttcttgccaactaactgccctttgctaggcttgagaatgcagacggtcaaaattgacgctattttcagagccacagaatttcaacatagcctatctgggaaggtacacattctcaaatttaccttccctgactacagaagttaccaaatgtggaaactttgatccatactttatctaattagataccaattagctttctgctataagaaatgtactactggggttagtactactgggggttagagcatcccaagtatattgaagccaatcatgtaattttcatcagcttttcttagaactcatttttagtcagtgctattcaaatgtattatgcacacaaatcccctgatgaacctgtgacaaatgaaggttttgtttcacaaggttggggaagaggctggaggttctgaatttctaaggtctcagttgatggcaatgctgcaagaccatccctttgagtggttagagtcttgggtccttgctaatattgtggtaggtaatgagccctcaccctagttagactgcagctttcaccagcagataccatcggacattcctttgatcgtatatcttccactatcagctttgtgtctcattttttcagcatactttcatttaaacgtgaatgcacttagagtaaaaccactcactgctcctcaaataattccctttaatcttgtctctgcgtcttttgtccctgtgtctttcttttatttatttatttatatttttctttttagtacccttcccctttgtcagctttgcaaaatccttccagaccctgtttaaatctttcctcctccgtttagaaactggcttgaaggggagaggtgtcattgccagatcttgaggccctgggaggaaatctgctggaaggtggggaggtgtatggaggatggaagcagacacatgagttaagaggctgatgtattagagcatgaaagaggtgacgtggtcttgaatctgggatgatctccaaggagatgttcctgatgagcttatgacttgggcaaattggctaagcaacctgagcctctgggcctttgtaaaattgcagagatggtcctatagtctctaaattatctttcagattaaatattctgaatttggtgggctgtaagcaaatgtgcacaggcctgttccaaagacttcttagtttggatcagtacattttagtatgtcacttctattgctaaaaatctttattttcaaatttttctgtcaaaggtttttctgaaacatcaactgagaatgaggggaaaatgttgctttaggagattttatctaatcttattaatagcaaattgtatagagatttcttatgaacatttaagaaatagaattcattcatcctaatctactgctagagaagcatttgtttatagagagactgggtcctttcatatcagaaagcaagtgacacctcagggaaacatcagctatggctttaagcagatgtgagtgtcaacaaggtttgagttcctcatgtgccttattgacacttcctgttataaatatgacttataggtcttttcaacaatgacaatgacaattgaggcctgaaattatgcccgattgtctgaatacttagataagacggcattattttctatatattttatttgtgatcaagttctgtgattgcctttctacttagtttttgctgtttttataaaaatatatactaaagacaaaaatcctgacctcattcacacatcacgtattagtagagcatgtatgaggtattgggtaatgagctaggcttctactcacggacctacaattaatgtgagaagtgaagctaaagacccaacctgatgattagttgagacttttcaagtatttctctctagaaaaggcattgatttgaggatgttgtttcacatttctgagatgcatctaggagttgtcatgtaccattagtatataaatccggagtggctaatcaggagggaaaaagagaataatttaggagtgacaaccagatacgtagagaagatgatgtagatgacagtctgatgggggtactggaattagtgcatagtacttaggtaagtctcatgtgttcctctgcagtttggatcataaggttgtctgatagagcctgttgtagacatcagataggcaccatctgcatgtaacccttcctatttctatttgtcctacctgcaaatcattttatttttgaagcacatctactcattgtctacatagactttaaagactcacactatattttatttcaactgtttcctgctttcatgtgatggaattacagctttccacacattgtttgctgccaagaccctaattggttattggacataaatgtcctgggagaaagtcaccatcccaacatgagttttagcctcttgcttttccaaatgtttgcaatatctttccaacaatttctttccctctaatcatgttctgcttctaaatgagacatctgtcaaagtacataaaaagacaaatgttataaaagtgaaatgatatctaatttttgacttatttagggggcatcttgacttacatgttttcattacacttgaaatataataattactgcatgttcaataacatcaatttgagcaagtaaacttgcaaggactcaataaggggaactgacagtcatgaatacctactttgtgtctggggatttgctaacattatttcattaccttgcaacggggtgtgtggagtgttgctactcatgtccacctatgtaaagttcagaggcctccatgagtccagaatacataattacatgaatcagagttaggatgtgaacacacatccataggactacaatgtaatttcctttcttgttggaatttaaagtgtgatccaaggccagcaacatcagcatcatctgggagcttgttagatacacagaatctcaagtgccaccccaaagcaaactgcttcagaatctttgttttattaataataagctcccttgatgaatcctatgcacattcaagagtgagaaatactgatttatacatcatgcctccaaagcaagcttctttttccctttttccctgtttcctgtcttctcttatatggctgcaaagacagtcatatggcatactttttaaataaatttatttcatttattttttcacaaaacacatctaattttctttgaaacagtccagggactcacagtactattccttgtttacaaatcctttttctttctttacctaaatagtctcctctcacagacaatttctttccttcttcatctttctcaataactgcaaaaattttctccaataaattgactcccattatcgtaagggggtagatgtatctggtgttaccctttctgtgttgtgaatgaggaacatttatggttaattcgtaggttcttcacttattttcatctcatttttcatgtatcttgaataattgctctcataaatgcccctcaaacataatttctacacacgtagtaaaaaaaaaaaagcacagtagtcaagtcgctattttgaataagcaccttagagtttctcctttcattttgtttatagcttataaatacagtttctacttacactgtgtatcacacagttaaatctgaatgatacattgagatcattttactaaatgttccagaaaataaatattcaaattcatttaaattcaataaaggagtcgactcatttcattttactattacaaattacttataatttttggtgatcagtgacattatgtaattaaacacacacatttttcttttaattttgagatatttttatgataatataaatgtgtgagatctttcatagatgattatatatgtgattaacttttttagatagccttagaatgaaaaaaatctctccaattaaactgttattttttagaaatacttcattagctttttctgcaatgacaaaacttttacctatttatgattaatagaattacccatgcttcatgttttaaatcaaacccggaatttagacaactaaagtaatctcaaaattatgaatttattccttatacagctacttatttattgttttttcacctgtcctgggataagatgataaaacaatatatggctcctgccataatattatgattaaacccacatataaacactaaaattacgtgaatttttactaaaattgcatgaattacatgtattggggtcagtgctacagtgttgtctgttcacagtagaggtgctatttggcttgagccttgaggaataatggcagatcaatgggtttagtactgaaggcaaagaaatgaggaatgctggcatatgctgtagcagtgactgagaggaggcgatggtgggatatgaagttggacaagagggtcaaggccagttcaagacaacacatgcaccatgcaaagaagggaacagccatgagaagccattaaagagccccatcccatattatccaatatatatttagtactcgccatttgccaatgattgtgctagtgactgtgtatgcaattcagttgtgtatgtaaaggagaaaaaaaatgatgagtctcagggcatattaaacaaagtagaagatatgggatttgaaccaaagatccactgttttcaacactcattcttcttctttataatcataaaatatatcatttatacaaaaaatatatattatatttataaaatgtgaaaaaaacaacattagtattcccatgtaccccatttaaaaaatgtgaacataataacaccattgagacaagtcctgtgctcctctgagatgtaaattatcttccttagcattcctaagtttgtaactatgtccccataatatattatatcttatcatacagaaacgtatttaaatagttttaacacataatgtatattttggtgatttttaagaaattcaaccttatgtttgtgagatttgtccctgttaacgtggctgtagagaatttactttcagggttcatttgtgtttcaacctcatttcttgtttctagatttttgctttactatcaatgacactagagaatttttatgtaagaaatattcatctttaattctgcaagagataatcctaagtagttttccaggtttttttcagtgatttacacccccattctcacaatctgctttccatgaccttgtcaataaaacttcattattttttttaaatttaagataatctactgggttgtaaaggcatttcaataatccaatttctacacaggtttttttttttcttataacttgttgatttttatatttctgctcttgtgaaagccaactcctgatttgaaagttgctttttcttattgatatatataggataggtattttttacatattctggatactaattcctttggcaattatgtgtcttgtaaattacctcccagtttatggcttgccctatgattttgacaggcagaggttcttaattgtagtacagttaaagatatcagcccatcctaattctttgtgtgcttcatgtcttgtttaaaagtagccctaccctaaggttatggatatgtattggtctatttcctttgaaaagttttaaagatctggtttttatacttaagtataaaatccatttgggattgacagttgtgaatgatttagcagtggatctccaatgctgtttttttctatgtgaatgtttttgaagagttttaggctgagatgttgcactaggttcatttttgcttaaaatggactggattagtatgtgactaaagacaaacagatcagtaaagaagtgactgaaggccaggcactgtggctcacgcctgtaatcccagcactttgggaggccgaggcaggtggatcacctgatgtcaggagtttgagaccagcctggccaacgtggtgaaaccccgtctctactaaaaatacaaaaattagccaggcgtgctggtgggtgcctgtaatcccagcaactcgggaggcggaggcaggagaatcacttgaacccgggagacggaagttgtggtgagccaagatcgcaccactgcactccagcctaaaaaaaaaaaaaaaaaaaagaagaagcgactgcaatagtccaagccagtgatgctgagggtgtgaactaggtcgctggtaataggaagaatagggagacatacaagatattaatacttaaaagccactaaaaacaggatttgttatctaattttaatgggtatgtcatacatttttctctttaaattcttatgaattttcagaataaaatatactactgccctactatggagaggtgtccttgtgtgtcctttacttgcagtgttcttcctttagtcatttgcagggccccttccttcacttccttcaaatctccactgaaattcactttttcactgggggctcctttgagcctcctttgcaaaatagccatatctgtctcccaagcatatatacatacaaacgcctggcaatgaatgcctgcctagctctttaccatgatatgtattgcttcatatgacttataaccatcttcacatgatttgttttgtaatgtttatattttcactagataacaaactctatgaaggaagaagcttcacctgtttgttcactgccatatcaccagagcctacttctgtatccattaaatattcgttgaataaacaaaagggcagaaagaacttgtatgtcaatgatgtgcgttccctttttagaaagggaggcttgtggcgaccttctaaagtttttggaattttaaccagcttttgtttctcctgcaatggtgaaattctggggagatatcagtgacccatttggcttagagctaccttcctattagattctattgtaacacttgtggaacaggtgaaaagtaaaggtgacaggcagtaggaaccattgggaatacaccaatttgggctgcacatgccgaggttagtccattcatcatctttattccacattgacagtaaaagcaatgatctctaaattaattagatccttagagataaagcaaaataaaactgtgaacattaataggcccgtatttcaacacctgcctggactgaggcaagctcttcctgttcaattgctttccttccctgccatggagctgcattcaccagcagtcctccagggggcaggctttgaaattttcagagttggattgcccagtctgtcttaatccatacttcagggaagaaaccatgatagttgactgaataaacatgtaaaacaccttgtagactggatcctacaatctttggtcacaccagagcttggcaagcatgttgtcttcaagccacactttagagacagaaacttaaagagatgtcagctggcttcagtgttggtatgaagcctgatagctcagctgagttaaatgactcccaacaaccaaatacatggctcttctagaccagggtttctcaaatgttaatatgtatataattatgtggagatcttgttgaaatgtaggttccagttcgctatgtctgtgtgggaatctaagatcctctatttctcccagtctcctctcagttgatgctgatattcctagtccctgaatcatcctttgagaagcaaggcacctagatttctggtcaaaatgctgaaaattaacaacccaaatttaaagatatgtggtttgttttgcttttttgttttgtttttctttgaggcaaattactagaaccaaccaaccaatgaaggttcttcggctcaagaacaaaaagtctactttgaaatttacattttgacatgaagcaaaataaaatgttaagcctagttatttttcatttaatcctaggtgagataaaaaataatactgcttctattaaactgacataattatagtaaaatgtgggtgaaataaaaataagatctttattgtatatggaaaatgtagaatcaacactgctaaaaaccacatcaataaaacaaaaaatgaatttaaaaagcacactcaggatgcaaaagcaacctctcaggagataaaaattagcataagagttatgaatgaaacaaaactcaggaccatagaaatattgagaaacctggcttatcacactcaaataaaattactcagtagaaactaacatgtagacattttctgataagttttgaaactgcaaagcaaaagttagatgttttattctacatagtacaaaaaatatgtttatttcaaagaagataaccagacaaaatttgaatttctcctctgcaatagtcaaaaccagaaagcaaaaagaaacatctataaaagtgttagaaaaatcaaatgtgaaccaagattttacatcttgacatgttgtccttaaatgtaatagcaacagaaagacattttcagtcatgcaataactcaagaaatttatcagcaggtatcaatctttgaaacctgtgctcatatcactcatggcagaccacagcatgtcctagatctgaaatgtatgagtgttttgatgagttaatcaagttaaagtaaaaaaaacacaaagtacattattcatcattattcataccctctgtttctcttttttttttttttttttttgagacagggtcttgctctgttgcccaggctggagtatagtggcaaaatcttagctcactgcaacctcttcctcccaggctcaagtgattctcctgcctcagcctcctgagtagctgggattacaggcatccaccaccacacctggctaatttttgtatttttaatagaaatgaggtttcaccatgttggccaagctggtctcaaactcctgacctcaagtgatccacccgcctcagcctcccaaagtggtgggattacagatgtgagccaccgtgcccagcctgtacctttttaaataagtcttagtatattgcattataacattgtagttgcttccatatgagacttcctcgagagcatggtaatcttgagaacaaagatctttatttacacttttacacctttatttgtattatcaacaatatgctcagaaaatgcttattaattaaacgggctgtcttttgtaacacagtctcatttatattcattctcttaactcctagatctgatcacgtttcagaattttgtggtggagaccataaaaatcattgacaaatcaaatttagagattgtatattgaagcgatctttccaaacccaattttaatttttaaagtaactgagggcccaaagctgtgtctgaagcatgacttggaacgtgtgtacacacaggtcttgagaggactatgggaaacagcagctggcctggcgcgtgactcctcagtcccagattcatagagcatcagggctgctacttagaagttactcgtactctgtgcaggtggcacggttcactcccaggaatgctcttcttttcattgctaatcattgttcaccattatctttgcaggctttatcaggatctcctttgatgtaatttgtagtataattgaattgcagcagatgaaagcatttcctcccaagctctatgactcataaccaagtggttttcaattatgtcagcatgtagctttccaaacaggtcttttcattgaccactatttgtatacactattgagttaactttggcaaacataccaattcatagactactgtggattctaattaaactgagatggagaaagataaaatgatcattaatttacattaaagagtagaacagggtgtttagagatttgcctaggattaattttataaataatattaatcactatcattactagtaaatgctaatgcacattctaaaacccagaggccgcatggggcttctccccgaagactaccactgatgaggaagcctgtggagccaggtttatgatatgggaaatttcttgatcctagtgttaaataatttagtattctctcatcctcccatgatgcctctatagtagaaaggccgacagctacttctgacccatgagaaaacatttcatcctgtaaagcctaagagagaattattttttgagttttaggaccaagaagtcagaattttactcttttattttcattttataataaccaacaatttcacatgtattttctgtataatttaaaaagcacttttataaatatcatcttacttcattctcagcactaagcctgtatgagtcatagtgaacacttgcacactatcatgtttggtagtctgctaagcactttatgtgagaggcctcctttaatcctcacaactctgtgttgtgccacctgagactgtatccattttacagagaaggaaagtgcagtacagaaagtttgcatagacttctagagatcacagagctactcagtactggagcaaaagtccaaacccaccatgctgatctgcttctagaaaaatgttctcatgattgttgctctgagagtgtgcattgcggtcatcgccgtcctcctggtttaaagaagtatcttccaaaacccatgttagtaagaggttggctttggtcataccatcctaggaaataattttttaaaatttgctatggcatcctgatgaaagtttgttgtgccttctccagagtttccataaaatgtccaggtactttttgctttcattttctgttccagttaaactcaggacctcccttgcatctcacctggaacaactgctctttactctttggcccaaatgtgagacctggccccatttcattgatttccccaccatttgtcaaagaaatagcaaagctttggggaaatgtatgaggtgttcacttaaaagcttacaacaaacatcatgagaggtttgacacttttgtttctttaaattttttgtgtctactacctaaatttcctcaaaaattttctcttcctgatctttctcttgagctctctgctttcccccatgtggctagaacccttctttttcctctcctgatgtcatgaacttataaattccctttggtctggaaatctcaatattctcattgtaacatgtgtatatgtcatgggatcctccaggtgtcacttcacctggaggttcacagaggtttcagctggaaacctctgtgtccggttgtgccttctgcctaagtattgctcacacctgctgggcttattccgcccacttcacctggcaggctgcactcggctcatgctactggcctggatcccacacctgctaagggtgagccaggggtgcagcagtgaggggtgtgtgggcaagcaagcacggagaccagccactgtgcactggctaggcatgctggctgctatggcagggcaggcagctccaggcgctagcacacgttttggctctgtgtgaagctgtggctggaccacatgtggtacatgtggcatggctgaatggtataattgggcatctgcatctggacgagaggaacatggtgttgcccagaagcttggagacaccaggaaccacagagccccaaaaagggtgtcacagccctggcttagggatcccctatgtctgggctccctgaacggccacagctcttctctccttcttgtcacccacaatgtggcaagtgggaggtgaggtgtttcagccatgttttttgttacagctcttctagtcctgccatttggcgtatcccgagttcttgtcccacatccaggacgaatgaggtatgcagacaactggagggtgatcaaggcaaagaggagcttcattgagcaacagaacagctctcaggagacccgaagtgggtagctcctttccgcaggcaggtcatcccgatgagtgtccagctctcagcagagaggagacccaaagtgggtagctacttttcacagacaggttgtcctgatgtctttctgtgagtccagctgagtccagggttttcctgggcttcagaagggaggaaatgcatgctgattggtccatgggcagccatgggtgggcccagaaaaagcaccataagttctcactcctggccgtggactccacctggaattccacctgaaggtgggtctttaccccttcccacagaggagcctgtctgcctcctacttccttaatcatgttgtccatagtgcccagtctgttcaagtggagggggcctgcaggcccacactgagccaccctcagcagccccaactcagaaggaggtggggctcccagctgttccaggctcccacaggctcagcagagcacgcagccccagccatgcttctcctgctgcaactggcatccccgcacccagctctggacattagatacacgtaatatctttgttgcagtcctcattttcccagaccatgcctgagagtgttccactttgtatggaggaatatgtgggtattttcataaatgaggacccctctactagaaagtaacaaagtattttcctgaacaaaattgtacttatctatgaagtagaagaaattgtatcagttttggttttaaattctaaatgatcttgccttttccacgctgctgaaaagatttccccagtttccagtcttgcattgtgcatttgtctcttcccctttaattcagcaattctactgatggctttccaagtaacagccccttctgtatcattgtggcctttggaacattttggttcctggactgcctttcttccaggacctcaatgaatctctcaagctacagatttcaatagcaaaattaccatttaatagctgagaaaactgaagcccaccaatattaaataagttaccgaaagccaaatggtgcctgagctaggactacaaacctgatatggtagattttttctatattttaagcctgaacaatgcaaattgcgatttcatataaatctcacagttctcagagttctgtggcctgtttccaggcacttgtgcttgttggttctttttctttttttgcataaacttgctttgtttgcttctcttacctctactcctggttattttgtccaaattggtccaagtttgattcaggtaagcctggactcttatctccatgaagaatgaaggtgtatgccccaaaacaccgaataaagatggactaaatggatgaaaagagctactcttggtaaggaagtttgccaggatattacactagaagttcaattcagcagccattaaaaggtctgtttccctggggagttctctactgaaaagacattagagcctttctcccttgcttctttttgtatagcagcttttacatggtagctgctgaatgcacagaataatgtggctgatccattgaagacccagcttgctcaggttagaaagacagagctgtgttactaggcaaagtgtaagaacaatttatgataaataagtgtgatgaagggaaggttcttggcttcactcaagcctgcggtggaagaaagcagctttacttaagcagcagtgtttatgcttggtgattgccccttgcagagcagggctagcccataggcagtgcgtggagagtagccacgcatgggctgttggctagctgcatttatacccactattaattgtatgcagattaggtggtgggttatttagaaatcaatagaaaatggggtggtaacttctgggtgttgccatgtgaaggggtggtaacgcagcgttgccatggcatttgtaaccgtcatggcactggtgggagtgtcttatgctgatgggcagtgaggacaactagaggttgttttctgtgccacttgctggttctggccagtgtcctctttggtttgggaaacaagccctgcaagtctcctacttcaggaggctgtggaagagggcaactaacttctcaggagggatcagaccattgcaggacaggaggcctgtggaaggaaaagaagacaggaggagatggttttcttattttagaaaaaagaaaggttttcttcttttagacacctgggccatgactcttcacttgttctttctcaagaacagtctggacactgagaccagaacctgggacttttaaattttaagcatatttttatgtatatgttgtcctgtctagcggagggtgggggagtctttcttttttttctttgcataaatctctaaattaaaattctccagctattgttacacataaattccagggctgcacagatcgatctgagtgttcccattaagtttctgattctaatgaagggaggactttacagcatcttccactgtctcccaacgcatcacacctcttcctgcttttccctgacccacctgccatttagaaaaacatattctctcagccctgctttgtgctctaaatgttaaatacatttgattgtccatacaattttatttgaaattcaatatctgctttggacagaaagtgttattgacctgctgtatccatacactatttactttgaaaataaaaaagtggatttactttgaaaagaaaaaaattttaatgatttttttaaaatcctaagtaatcatgatgatgcccttaagaaagtttttaaaaacataattagacgtattttgtaattgggatcattcagactgccaagtgttcaagcttttccttatttgaaggcacattaattttttaaaataatcattaacgaagaatttacttctcttaaaactaggttagctattgttctctctctgtctcaactaatgagtttgatattcacaagaactaattgtgagattttgtaaagccaatgctatgtcaactatgctggaataagactttatgagaaaaacataaacatacataagctgtcaaataaatcattctgaatgatgtggtagaaagcttggtgctaggagacctgataggaattttaatttacccatttacttattcatcaaaagtatataaagcactgatcctaagagaagcagcaaagccagctgcaatttcccagcagtgtaaccttgcgccaatgactatatcctctctgatcctttgtcaccctaaatgtaacatgaaggaaaaaatatccattacagcataatataataattactataaaatataatatttacccaagattcttatgagtatctgatgaggtgacatactaaaatagatgagacaacagagttggaagcattttagaagacctaaagtcattagtggtgtttgtgctaataatgaaacatctattactctgggtcctttgctgagttccataagaaggagaaggttatgtaagaccttattgtgggctttacatgctttggcatccagtacaatggaaagagttagaaaatagaggagcattgaaagagaatccccaaggctgggtttagtactgcaatttgcaaatgagggcattagtgaaaagcatcctccatggatgtgaagcagaacttgcagtaggcagcagtgctctgggagggcattttagagggggatacacagcactgaaccttgaaagatggagaaactcagtgaacacagatgggtccggaaatgcacacaggacatcagtctacttacaggatggtttccgagagcaacaaagtgagtgaaaagactaacaactaaaaatgaggagaggtttggatagcagagaagagtggagtgattcttccttaaaggggaattgacacttaacatcagatgaatgacttagaacctagatctatcagttatactttgcactgaaaagctacaaacttttaacacttagctgtcccatctgtgaatctctgtggctcattattgctgtgaggattaggtgaaataaatacatcacagtgtctggcatatattaaattcctaataaactttcagttttatttttctactttccttttccttctctttatattggcagtggggtttctggcccttaatttagagtggaaacaccttatggttttctcttatcacattttatgacttagatatctcttatgtttatatcatctgctccctacatagtctgggcccggaaatgattatactcagagcatctctagcaagacagctagataagcagataaatgcagccctcaactttttattaatcaattgaaactacttttccatttaaatcaaagccctttaaaacttccgaattatattattaatgtccaggagaagatatgccatcagttaagtatcctctgctgcctattggctgctgtctacttattgtaaaaaaactagctatttctaagtgttgatgatttcagatttgagttcatcttgttaagtggttcagaacatcaactcttagcatacattccctactgctaaataaaaggtgacccttcttttaatcgtttttgtggtttctcattagagaataggtaaataatgaaataactagagtcttcccttgctttcattcagttttgtgttgttctttccttccagttctttgcaactacacgatcaaaaacattttttttggtgcacattaaaaagactagagaaatgctttaatactttcgaagactgaatatcttaaaaatggctccaattctactgtcttattcaagcaaggtatttacttcttatttcttttctatccatttcatgaccttgttttatttcaagcactatcacagagtcagatggaccttaactcacctgagcaaaggcaacctagagccacacagctgagctgccctctttgtggcatcacgttgtccctctgccccacagagtcacctccccacttcccttttccagccctactgcccttttgtaagtgtaagacatcatttcctctcaactgcataacagaaatagcctctgaaagggcctttttacagctgatttcttctgtctccaattcatcgtccatactgcatccaaagtcttcttgccactgccttcaaaatttaaagctgattcctaaattatgaatctttgtcactgggaaggcaaaggacagttgcatagtctggttgagtgaagttttgcccacacttaactgaaaaaaaaaaaaaaaagattcctgtgccccttctgagacttgctgaatcagatttgaggaaaaatcctggaaatctataaacttagtaagcataataagtgacatttataagtggcctctttagaaagccagccctgcagagtacacagaatgaaaatctaaaagtctgagaatcccaggttagaattgcaatactgcatttaacatctgcagagagcttccaggtaagtcacttaacttccctgactacattttcccattgaaaaacagaggtattaccaacttacactcatcactactctgaggctcaaatatgacaaaatacataaaaaggctgacactcaatgtataattgaaccttccacttccctttttgatctaaacaattactcttctgaatatggtggaaaggttgaatggtacatttctccctccttccctgctaccctgccccccacatgccagctgggcttgcaaaaggcagaactggattccaaaattatagcagcagccagtatggtcttcggtttccctgcagacacatgagtcaatggagacccacaggactgaaacatagagggtttatgtttccctgaaaagcaacagaactggcgaaaacagctctgtttctcagagatgagtgcaaactggacttataatgaaaagtcaccaggatgtgcccagagaagtttccagcaggaacacctgcccaaagaataatgtgggaccgtgcttcagcaccacattccagaactctgagtccaaacagacccagactaccgggaagctcctgcaagcagagcaggacaggtgttgatgcacatctgagacggggagttcctgggctcaggagaagggaaagcctcctgagcagcagcccagcagggagagaggcactagccagtgggtctacgtccaagaactgccacaaaggtcttaatgcatggtgccaacactatactctggctattgccaagcttgactcctcagaggatctctggggtcataacttgctctacacaattgttctgaaggtgattgcaggtgtgatttctagaggtggcctgaggcaggctcaagtggaccccagattattgagacctagaaatgggaggcacacactctggttaggtgggcagatgtttaatgtggaatccagtatggggcatggtttgtaggcagcattttgcagaaaatatgtccaatatgccctgcctggttttgtgaggccagttccagtcccctcactaacctgtcctggagtctggatggcttgattaagattctggaccacagagaacccagacaactgaagctatctttccctgcaagtggccactaaggggtctttcctttcttctaaagctcaaagcttcaaaatagtggtgtgaggttgaataagccatttaatctcctcagtactctcaagtatatagcggggctaacaggctgactgcggctaactaggataacaattcgaatgcctagtatacctgttgtagagtgctagcctcattgttattccccttttacttttccttcttctgccagagagatcatctgggtattcatttgtgtgcttaccgtctgacacttgcatttacatcattatctgccactccaggttatttttctcctctgagagccaaggatgacaaaatcttccttagggtaatcctacctgtggagagagggcaagtacgaatggtgtttctctagtacctgcaggactagtaggtgtggggatgtaagagcactgaaatgaaaaagtgaacatccttagagactggctgctttgggagtaaggcagatgttctaacgatttagagaaactctcagaacaaagcagggataggctttgggaaccaggatatgggattctgaagtgggaacaaatccaaagaagcatcattcactcatttcacacatttatcaagacactagaatgtgacagtgaacctatcagacttgcttctaggcttatagagctgagagagtggtgagggagactgttatgtggtcagaatggtgcaccatcaacgttcccccactcccagttaggactaaggcactgattctcccagctactgggaggcttggctgctgacaggtgagagctcacagctgtatatctcttccagaattgcctttgcggaggagagctgacacaggtgtcagctagcatcttgcagctggtagacacagggacccagccctcttccctcatctcagacaaattttatcttcagagtaaccccagggcttgactgaggtctccgttgcagctgcattacagttcacttgttccctagacccagttcttttttttaattgacgtataattcacgcattataaaatacatccatttaaagtataaaatttggtagttttttagcatatacataaaaagttcttcaaacatcacccctatctaattccagagttctcatcacctgcctgccaataaaaccaaaaacaacaacaaaacaacagcaacaaaaatccatactcattagtagttgcccctcattcatacctacccccattccctggaaaccactaatctactttctgtctctatggctttgcctgtttcagacattttattttacatcttattatacttacgtagccttttgtatctggcttctttcattcagcataaacttttcaaggttcttttacattgtagcttgcaacaccatttcattatttttattgtcaaataatactgaattgcatggatataccacagtttatctttttatcaactgatgggcatctttcctctttttgattattataaacaatgcttctttgaatattcatgtgcaagtttttgagtagacatgtgtttttaattctcttctctatatacccagaggtgaaattgctgagttatatggtagctttatgttaaacatattgaagaacagtcaaattgttttctgaaggggttaccccatttttcattctcaccagcaatgtatgcggggcttcgacttttctgtgtccttcccattacttgctattacctgtctttttgattctagttatagtagtgtgtgtgccgtggtattccattgtgatttttattttcctctacctaacagctagtaatattgagcatcttcttatgtgcttacaggctgtttgtatattttttttgagaactgtatatacaaatattttgcccattttttaattatagacactttttttttttttttgaggcagggtctcactctgtcacccaggctttagtgtagtggcatgataatggttcacttcagccttgacctcctgggctcaagtcatccccccatttcagcctcccaagtagttgggaatacaggtgtgcacgaccatgcccagctaacttatttgcttagagacagggtctcactgtgttgcccaggctggccttgagctcctggactcaagacatcctccttcctcagcctcccaaagtgttgagattacagaggtgagccaccacacccagtcagttggtcattttttattattgagttgtcagagttctttatgtattatgcatccaagtcctttatcagttacatgatttacaaatattttctcccattctctatgctgtcttcactttcttcatggtgttctttaaagtacaaacatttgtcattttgatgaagtcaggtctatcttttttattgttttgttgcttgtgcttttggtgttatatctaaaaaatcattgcctaacccaaggtcatgaagatttgcacctatggatttatttctaagagttttataatttcagctcttatatttatatctttgatacatcttgagttaattttttcctttgtgcagttctgatcatcccaatactttacaggtattgctcccaagtacactacccaataaatctcttacactaaaatatttatctaaagtttatttttctagaatcagacagattattcatagaagtacaggtacaatatggtaattgaggaagtggtggaaactctaagcacagctgtccaggcagggttctgacggctggcatccttccaaagggcaggcagtcctgtagaacatccttactggtttggacttcttttttcccagctttgctctaaaatctatactattttatgacagtgtttcagtcgtagagttcaaagcacaggcaaattgacattcaaaacttattatcggatgaagttacatatctgtttatatatttcaacaagggaaagctaatcaatattctgtagcaattgttaccatgtaacatacgattaaatattataaaagtgagcctattacatgagaaataaatataattatgtttggtccaggctgttaaaaatgcatactttctatatattatatgttaatgtgcaagatggagtggatttctgcttatttatttaaaaagaaattaaagtagtacatttagcgtacattgtgtgtctagatgtttacagattgattgtctttttggagatattttagcttattgtattgtaccatggagtaaactttatgctcagaagttctaaaggaaaaagtgtaagagattactggaattgaagatttttgcatttatatgtttaaattaaattttgattagctgttttaagctttgtcaagcattaggagctcataatcatagagagtttgatatgaaggataccataatcagctactctgtgctttcattttacataaaaagaatcttcaactcaaagaagaagactggggtaattggccccaggttgtggatgaatcagctatgactccatttggtatccatatctgaccattcctagccccagggctcagttcttgcaacaagctgcctggatgttttccaatgtggctcaatgctgttaatttaaaagatgcgtaagtttctgttaagacatttgtgagttggggcagaggaataaaaggcatgtagcttttttcatcaagtgtgacaacacctgggtgttaggaaacacacataatcaacttagatgctcatcagtggtgggctggatgaagaaaatgtggtacatatataccagggaatactacacagccattagaaagtgaaatcatatccttttcagcaacatggatgcagctggtggcccttatcttaagcaaaataatgcaggaagagaaagacaaatactgcatgttctcacttacaagtgggagctaagtactgagtgcacatggacgcaaagatgggaacaacagacactgggcctacttgaggtgggagggtaggaggagggtgaaaatcaaaaactacctatcgggtattatgcttaccacctgggagaggacataccttgtacaccaaatcccagagacatgcaatttacccatgttacaaacctgcacatgtaccccctgcacctaaaataaatgttgaaaaaaaaagccactaaaatagtatttcacatcacttttcattgctaacagtttgttccgtcaaaatactttctaaatggatccattattgtttgtcagtatataataacgtgtgtaaattcccatagatatgcctgagttttacacttttcatttcatatcagagaaaaaagcttgaaaaataactcttgatattgagaattttaacagtgagattttattatactcaaatgaacaagttctcatcttcatagcccatatgtgagactttttgttaccaaattgtaaaaaaaaaaaaaaaaaaaaaaaaaaaatcatgtaacgtagattaaaaatctaatttcaaagactggaacaacaacaaaaagaaaacaaaggcaacagcacacagatgactgtgacttgcctttggcccatctgcagatattaaagccctggggccagaagcaagtctttctcttgctgagagaggacctgcctgcagcaactcctaggaaggctgatgagcaggtagtacttcctggagcagaatgggccacccttctcctttggctccattcagaggaatagccccagggagaggtcctggaaagtattataataattgcagaaatgaaagaaaaaacccttgttctgaagcaaagggtggacttttaattttaatagtagctaattatccgtgtctgtaataattctgctgtttttgatgtttttaaagattaaaaacaaaatctcagaatagctttcataaatcaatttgaccttgccgtgaaaccaaaacaacggttaattcactcgaagcagagatataataggttcaaatagcaacatatctcccagagtcaatttcaacaagacaaaaacagaataaagtggttcatatttttatgttaaaagtaattttataggattccttttgttgcgctgaatttaaataaatcattataaacctaatatatgcctaatactgtcaccatgctgtggcaaccactgttaatatttccatgtgttttctttgaactttttttaattctttgcatgggtttttaaaagagtgttttagattctgtcataccagatggagaaacctctgcccctactctgaagggatatccccaaatgacattccttggaattctgcatcccttgaaaaaggacgactggctgtcttctgcatgagctgttccgagacccactaaaattggccagggtgactggtacagtcataggagggttcagccaagccatagcattgtccagagcaaggatggcgtaaagaaggctttaacaaaatatatttgattataaaaaaaacttctgctaggaatgtacaaagttcattgtccatccggacacccaggaataagtgagaggtacatactaattagtattttctaacattgcttacttctgccccctgcctagtcacaggctgagagaagaatgcagcaagaagcatcttaactggaggcccattctaagtccattttgaggatgaggaaacaggccagggaggttaaacgacttgtcccaggtactgtggctggaagagaggctataccttacctactctcctgggtgcccttttacctctgtctttagaggaagtgcatagatttttctcatttggctcttgagacctgggataaacatagtgctaccctaagtcttgcagttacaagaatggaaatattctgatttaagttatagacatttgtttgaattttaccattacacattttttaaatcacagataagatttttcacttgaatgaaaagtgaatattataaaccatgaaagcttatatgaggctacaaaataagttgggagtggctatctgagaagaaaagaaagatgcaaaatctaactggcaaaggaataaaatcaaatcagacaccaacataaccagcttcttccgccttcccttagatgatagtcctgaagctgctatgctgaacatctgatgggaagtaaaaggcattaacactctgtaaaacatggcaaggaatatattctataacagttcccctgcagatgaaaatttgccctgaggtatagttcctcagagaaaatgagtttttttctctttagtaaattttttaaagcctttttgtttgtttgtttgacagcctgtgctgcagttctaggttctaagcatatacaccttatattcctgttaatggaatttcagactcaatgtttgcctcaccttttgtgtatagttcctcaatggcctatattggatacaaagtcttacacagttttcacccaactctagtgattaaaaaaaagaaagatctgattggagcacagtgcagaaggagagagtggcatcattttggagctctgcatttctggatacctaccttgcctttgtcacttgtcaggtctatgattttaaagaataattgaactcctttgaatcaccactttatctgcagatgaggtctggaatagtcagagatggttttctgtaacaagtgagtttcatttgggatttgtataatcagaaagatgataaggggcaaaccataatcaaagccccagagatgcttagcaatgagagcaaccatgctgaggcatagtaaactatgacactgatcagataatcaaggtgaggtgcaaagtcaggtagaagtgctcagtgctgaggtagtaagaactagggaaccaatagaggcttttgactcatggtctgagaagatgagaaacagccactggaagacagatccagtagatggacaagagggattgatttgaatattttggagcctggggagtaacctagagatgaatatcgccaggtcattcaggtttttgtttggttgtgtgattacaactaacagagactataatttaaaagcttggtggaacagattactaacaaactaataaattatcccaatctcaaggctaatcaaacctatattttggttgatttttctacaaggttgtgtcaaggttataggtaaggggtgatcactgagtccccgtcaatgagatacttgcccctgggtggacaagtgagtactagttgccataaataaaatcaagcacctctgctaccaacatttttgcatttcacatcagagagctgagttccgtatcttctcatggtgatctttgatccaagttaaaggccgacattaatgttaacagtattttctctactgtatattgtgactcatttttgagttgcagatgagactgaaactagaacttctcttctttgcagagtcataagtcatgttaaaatattaaaagctcagaatagtcctaatcggtttaactttgtataaacactcagatatcttgcatttctttgtttacaagtccatttctcttgtaatttccctgaatatccaatggacctagaactgtccaaaacaatgtagacaatcgctaggtctaagatatttgactttaaccaaaattgttaacaaaatatcttttccttctaggacagtggctcaatatttaatttcattggaaaccacaggctaagtctgagtatatttatgagttatattttcagctacctagatgatttacaacatgataatttagaaggagtagaaaacttggagttaaaaattctgagttaaaacctatcttgatcacaacctaagactatacatgttcaatggatagtctttttatttattcagtgtagtttcctcatttataaatataataaaacccacctgtaggtaatcatgaggctcaaaaacgactgcacatgagaatcttttgtaatagctaagcctcattagaagctgtattctggtttgaatgtgcttgtagcctatatgtttgtgttgctgcaactcctaccttgctaaaaagagataaaggaacccatctagggaaactgttatgctaaggttgagttcctaaagccatggtgtacttcaaattagggaacaggaggagttgaacaagaccatcaaggaaaaaatttattatatacagatttctggcacgatttacaaataggcaggtccctgggctgatacagaacatgcaatgctgatatgttctggatatctgggacagtgtttgcaaaacaaatagaaattgaatgcctttatgttagtcataggactcactgctaatttattaatttacgtcttgctcaagacctatttatgtccctcctttgttcccaggaacattagaggttgctaacgttgctctaagacttgagcttaattaaggtgacctttgagatgaactggtccttatcagggccagtgaggccatgaagagactagatccaagcagtatgttttaactggcctacacaggtctccctcagcagccctgagccagggaactcaacaatattttagggaaacaagaagtctacttaactgataggagtcagatttgtacctgggactgctgatccaaagcctataaggaaaaacatagccaaaaagaatctgccttaaactgatgtgaactgactatccagatccatataattagaaataatattagaagacatcttaatgtatatagtatcttatggaacacagttttttttgtgtgtgtttttaagcagactttatgtaccaaattaagaaattattattttaatgatgaagtcttggctgggcgcagtggctcacgcctgtaatcccaacagtttgggaggccgaggtaggtggatccctgaggtcaggagttcaaaaccagcctgaccaacagggtgaaacctgtctctactaaaaatacaaaaattagcttggtgtggtggcaggcacctgtaatcccagttactcgggaggctgaggcaggaggattgcttgaatctgagagacggaggttgcagtgagctgagatcgtgccattgcactccagcctgggtgacaaaaaaataaaaaataaaaaagttatttgctctagggcatgcagatggaaaggggttgcaacaggtactggagtcagcattgctgtccaaagccttatatgcacccacccccccaactacctacctccctgggataagattactaatgacattattttccttaggagcagacctctttcacacagcagtatacaagctgttttgctttctacctgatgttgagaaaggcctgactcttagatgttgcctgatagctactattttctcactttgcatcacattagtgggagccgttgctggagagtttcataaggaacattctgttaagaatgtgtaaatttagattactaccactgggaatttaaaacaatgaagagaacaaattctgctaaaatatggctctgaccatctttaagacagatgctgtgaccgtcctttagctcatggctaatctgaaggagctagtctgtggagacaggggcttccttagcaatgcctcagataaaaacttgggcccagttctcaaactcataactgaaatatttcagattaaatccctcctccttgttgctgatcagtccacgtactcttttccttaaaccccattgaaaattcactgtcctctaggtgccatcattctgtagtggtgggagtacagattggcataacctttcagaaagcagacaggcaatacaaagcaataataatatatggcaatattaagggagtctatattcatgattgagtaaccaccatgctgtgaaatgaaatgtggtcaaagatttatatgcaagagtttaataacattgcattgttatttattatagcaactctttcaaaagtgtgcgatgagagggtattatttatataaataactttgcaatcatatgatggaatattattctgccaagataaaattatgtatttgagaaatatacttactgatgtgaaaaagtgcttaagacataataggttaagaaaagacagacagaagaggtatgcatgtaattgtgtgtgtgtgtgtgtgtgtgtgtgtgtgtttctgaacatcacaggcttcattagccgatggatacaaagagatcacatcaaagtccacagtacaatggtcttacaactttacaatcttctcacaaagcgagtacaaacctgtgctcagtaccaaacccaggtagactgttttctccctttcctggccttcttatcaaagctgtttccatggaccttgctgtggacatctttcattagaacgctctggtagctgtatcacttagaactcagggatgccattctattagaaaggaggtgctcttaactctcaaatttttcttggtcttaaatattgcattgagataagggaataaggaagaaaataaaaatgcatctaatgcctaaaaatatatggactgttgctaggcatttcaccccattcatgtcatctgttaattgtcagatgttgtcactctctctgtttttaatacagaacttcaacagatcttaagagcattctactcagtcattttagatttgaggtgctattctgctctctaggaagatagggagtctcaatcctgacccagactcagttcccgagtgcggtactgtttcccactgacagatgccactgactttgcctgcctgagtctctaaatattgcagctatctagctgtattccatctgcccacctgtttggactttcatgagtccaactgctttcctggcctcccaccagttgcctaatagcattctacttgatggaatccatgttccctgcccttctgcataccagcatctgcagccgaccttccaataccgatcccagcatagtaggccaatctaggtccaagaccaaggtctcctagcctaaggatttaccactgtggttaaccctgccctgcctgggcacaacaccttcacaattcttgaagcactacgtgccatgacacacacatttgaagtttttttcagaatcttccatgtttaaacttttggctgttccagtttccccaaattaaattatctggaaagagtgagcagctgaaatttgagtgcatttttgaagtttaagaactgaaaaaagaaaggaatatggccaatttaatattcctgtctcttaatccacttcacatgggagaatggaggtgaagtgaggttgtggaaaataataaagccaattactttgcctgttcctttgtttgatatactgcactcttttttattttttcttttccaaaaagcagagatcagccagtacaaaatggtggttttcccatcctgggtatatcaggcccagatcatcaattattattgcagcattctatatttgctctcatagatagtgaaagctttgctatattaatgaggaatttttgatttcaggctgtgccttctttgctcgtctcagctcttggctcttcctaaaaactgtattagccaggaaactgagcccactgattttttaatctatccttaaccctgccctggaacacttagcaatttaggcatgtggcaggaagaactgaaatttctaagccgttcactcctgagactaataccgagtcctcttcatttatccttgacctttttagttttcagccttgctccctaggggtacttccatgaagacagttgcttcctgccccatattaacaaccctcagtgaatgtcacagtagagtaacagcgaattgcaaataaagacggccaacaatcatttggcatttgaggaaagccatagcataaaacagggtcactgaacttaataaaaaggaaaagttatgagagtaaaggaaatatcatgaatggcctaatctttctgtcctggatggtctttattccttaataccatcaaccactcaaggtgctgctgtgtccctctcagaggtccactctcactcctcctacctgaaaagaaactcactagttgctaattaccaatatccacttagggtgagttggttgggacatgctaattcctccttgctgaccctactgtgatattcctgtgattggcctggtcatttttccctgggcctcacttgcagcaagctgcttaggtaggaaacacttagagccactcctcacattatgaggtaagattctcctctggttgtctgaagctgtaatctccattttcaatctggtcctccttcatttccagatgtgttaaggaattttttaaaaaatttctatctgttatgtcattaagaaggatttgtagcaggaaaacgaggctggcaccttttctcaagaagctatcttgacctgaaacttacattctttcatcatcatgccattttcatctggtttcctgagagctgcctttggcagtcacagttggaaatgacattttatacaggctcttatatcagagcaaagtatggtcctgataaaaggttgtgtgaaaatgttcagcaaacacctctcaatcccctgtgctttgatgtcctgcatgcttttataatggccacactccagggcagctggagacaggaaatttcatataactgggttgtgtctgaacagaatcagcacactccacgatgagattcaccatattcacatttggtatattccctttccatttctttcaaacttccgtattaaaaatgcaagatttacattagtatagaatactaaccatcaactattatcaaaggaaacagaatggggagatgaacaaagagaaagagatgacccagaatcagaaaccctgggttagtcttggctctcagtgattaagcaatttgtccagcatcacagatctacaatgatcttacagtctcaatccctcattttcttcttttacaaagccaatggttggcagaggctgactagatttcatgaccctccatcttgttcctgttctgagcttttatgaagttgatcttattgtcatcagcctatcatcagctttgcaggacagccagatgaaaggagtgcaggacagacactccttagaatccctttgtaagtttttcaaagatttgctttgttcagatctctgaaccattattggggactgtagaataggtactgaagaagaaagaatgcctcgcttaagttcaattcagtcctgtacactcagagtgatctctctgatatgagaaagggagttgttgacctttggattaagtgattccaagagaaaggactgtttagagcgagggttagcaaactaccaccttcaggccaaatctggtccaccaactctgttgtatggctgacaagctaagaatggtcttcacatttttaaaaaatcagaataataatattttgtgacatgtgaaaatcatgtgaaattcaaatgtcagtgtctgtaaataaaaagttgtattagaatatggccatactcagttatttacctattgtctatggtggctttagagctacaacagagttgaacagttgcaatagcaaccttctggcccccatagcctaaaatatttactatctggccttttataaaaaaaaattgatgatcattggtttacagagatgtattgagagttaacaatctgcaggacataaggaaagaatagcaactgatagtttacagatgtcttcatgggaaaggtattctagaagttcaaggacaagatattattgagtataaacatacacagagcaagaagcagcagtggatgtatacgcttacaaatgcacaggcagatgccccccatgtataaattttcaactcggctgtcctttgtgataacacttggcagaaaaaacttcaataactgaacacaatacctttagcgttgaccattgttattttcttttttttaattatttctatagcattgacattttattaggtattgtaagtgatctagaaatgatttttaaatatatgagaggatatgtgtaggttatatgcaaatactgtgccattttctttttttattttattttatttttttatttttattttttctaattttttttattatactttaagttttagggtacatgtacacaacgtgcaggttagttacatatgtatacatgtgccacatgtgccatgttggtgtgcagcacccattaactcatcatttaacattaggtatatctcctaatgttatccctccccactccccgcaccctacaacaggtcccagtgtatgatgttccccttcctgtgtccatgtgttctcattgttcaattcccacctatgagtgagaacatgtggtgtttggttttttgtccttgcgatagtttgctgagaatgatggtttccagcttcatccatggccctatgaaggacatgaactcatcattttttatggctgcatagtattccatggtgtacatgtgccacattttcttaatccagtctatcgttgttggacatttggcttggttccaagtctttgctattgtgaatagtgcctcaataaacatacgtgtgcatgtgtctttatagcagcatgatttataatcctttgggtttatacccagtaatggtactgctgagtcaaatggtatttctagttctagatccctgaggaatcaccacactgaattccacaatggttgaactagtttacagtcccattgttattttcttagcctcttacccattggcttatttgtgctaagttttgaggattcctttttaaactgatgtttaactgtattatattcagtgagtacaaaagaagtgagagtttcaaaactactgataagaaatggcatataattattaaagaaggaaaaataaagaagacgaaaaaataaagggaagttaacgatcactacctgataaatatttggacgcgaatcatgattttgaaggacaaagaatgaaatgtgtgcaaaagcagtgtggatacaacccagactaaccagctggtgcagagggacactggtaaactagacaatctttgcagtgtgtcttgtgtttacaacaatgcaaatgcccgttagattaatgctgttgagaaaaagaacaggagttttggaatgaaaggctcatcatggttaaaatgctgctgaaaaaatgcttgtcatgaggtgcaggagctttcaaaggaaaagggtcactattgtgtcaaagaaaacacagctcctagggagtcataggataaggcacttataggatcatcaacaaacagtagtacctgcatgtacgcattctcagagtatgtggaaattggcttatttcaaaaaacaaaaccactgataggctcaatagaatgttatcatccaggaggagcaggagtgatgcttaatttgaaagagttggagtgtctgcacacaccatcatttgctgccaatttatttagcactaagcttaaaatcctctttggaggagtaactttggtcttttaaagaaaagaaattaaagcaagtttttagaaacagacattagtaaatgcacgtgttcttgctgatacatacagagggaagcagtcagagagaaggatgaacagattataagtcaactctgaagggtgtcagtagaggttcagtaatgggcagagtctagaaaatattatcaatatatacagaaatgtctgtgtatgttaaattaagggaacctctgcagagacgaaaagaagagattttgtaccattcatgatgacatttgaaaataacatttttaaacctctcattttatggtgacaatagatgcccatctctttcacatagagaagtttaatttgaaataaaagtaaggaatattctttttattttatgatgacagtctcatgctcaacaaagatttagagaagttagtgcaacatggaaaattgagttgtggtgtaaaatgtataacttcttgctacatagctgattgtgaatttgttctttatatgaatttttttaaagaaataattgaagtttataaataaaatatttatgaatatgacttcattaagaccaggtgtcaggtgtatcttagttctgttttaattatatacatatacacacacacatatatatttcttttatgttctacatactctgctttatagctgaactcatctgtatttgtccattttcatgctgctgataaagacatacccgagactgggtaatttattaagaagaaggtttaatggactcacagttccacatggctggggaggcctcacaatcatggcggaaggcttgtcttacatggtggcagatgagaggatgaaaaccaagcgaaaagggtttcctcttataaaaccatcagatcagatcttgtgagacttattcactaccacgagaacagtatggggaaaaccgctcccattatatcccactggatctctcccacaacacgtgagatttatgcgagctacaattcaagatgagatttgggtggggacacagccaaactatataatcatcatccaaactgaaagttgtagtaggatttgtattaacaaatatttgaaatctgagttataatttgtcaaatctatgatatgcatctaaaaaattaccattttcttaaaatggttataggatactctaatattcagctagtaacaagtgctttttgggtcaggaaaacattttttaacaaactgatacttatcaaatcttagaagtttgatgtcattatgttgaacttctactacaattaagtgagaagataaatgcagagtaaaggtttctaatagcattttttatttataatctcaatatatgttcatttcataaaattttaaaaattaagagaagtgtgaaaagactctacaataccatcaccaagggataagtaataagtatttattttcttttatattttttaatctactatgtatatgtataaaaatatagatattattgagtaatattattgctttcattttccaaaactctcttctaaatagtatttctatttttagttataattttaaaatttaagtggcttcattgtttttataaaatatgtgattattttaaaatgtaacgatgtatgtacacaaaataaaaatacatgaatatatatttatatggaaacgtatacttataaatgataaaagaccaaaataaatgttactccaaagtctacaactcagtactaattatattaaaaattaagtgaatatctttctaaacaatcactctgctgatttatatctatctataggtattaaatatcccaagaatgtacagatatctccaattccaattcagtgttacagtattcattctagccttccctctttccttatgctaccttccttcttcaacagttaaaagtatggctttcattatctataacatatatacttatttgttcagtcctaatatgcacataaagaatcccacaattttcaacctatatctgtataaaaaacaagtttacttacttaagtgtagcatttgtgcacaaaaagtgtttgataaatttttctgggccaaaaatagcaactgtaggaaactgacaaaggtaggacaaagacatggttttccctcagatatccgcgtagttaactccttcactcccatcaggtagtgctcatgttcctgtcttctccgcagcctacgttggtggactattaatagcataatctcaccctccaccccacctagaccatcttgatcctttttctcctactttgtttcccatagcacttatcacattatagcgtgcatgttcaacatacacatttttttttaaagtgtacttttacatctctgaaaggtggattctgataatcaatgacatcataattcaattggaggcttgcaatgtactgtattttagatttaataagtcatggcacataatttgcttatttatcttacattctattttgcccaattaggatggataagttgacaaagtcaaagttattaaagagaatatcgtaactgctataagaaagcaaacctcaaatctcagtgcattaaaagaacaagggtttatttttctcttgtgtcatcgcaggcactctgttccacatagggaacagagcaccctctgttggattctctacctccagtcagcttaaaatggagagggttgaaaattacttaaaagtactgtattcaagagaaagcctggaattagagtttatcacttctgcctcgtgtctttttttttctgtattaatcagagtattctaattgctgtgatgttgtgggttgaatcctgtatcccctaaaaagacatactaaagtcttaagccctagtacctgtatcgtaatgtaatattacttgaaaatagtctgcagatgtaaccaagttaaggtgggatcatacaggattaattgggccctgaatccaatgcctgatatcttcataaagagagagaaacttgaagatggaggacacacagagaagaagttcatgggatgactgaggcatggactggagttatgctgccaaaagcccaggaacacaaaggattgctgccaatagccagaaactggaagaggcaaggaaggattctttcctacagccattggaaggagtatggccctgctaaccccttgatttaggacttctagcctctagaattgtcaaagaatgaaattctgttgttttaagccatttggtttatagtaattcattacacctgccctgggaaattaataccccactccttgtaccaaaatgcgtatcagcgttctctagagaaacagaagaaatatgaatagtgatgattaattagtatactgatctacattatactataatcacattatataatcatatcctatatgaagagatttattttagggagttggcttacatgattatggggtctatttagtctgagatctgtagggcaggccagctgactggaaattcaggcaggagttggtactgtatccttgaggcagaatttctttttccagaaaaacttcagttttgctcttcaggcctttagctaattgtaggatgaggccctcacaaactattgagggtgaacttctcttacttaaagtcaaccaattgtagatgttaaccatatctccaaaattctgtcacagcaacatctgaattagtgtttggttaaataactgggtactatagcctagtgaagttgacatataaaggtaagcatcacatatgaaaaagtaaatcaacatttttgctacttgacccaacaaaagtttatttctttctctcatcatggccaaatattgtgtctattggtgtggatggagaggaattctggcctccatatagccacagaaaaaattgggaatgaatttagaaatacagaacccatctcgcagctcatccctctagggctgcaggataattttaaaaatcacttgaggtcaggagtttgagaccagcctggtcaacatggcgaaaccccatttctactaaaaatacaaaaattttccaggcgtggtggtgtgcgcctgtaatcccagctacttgggaggttgaggcaggaggaacacttgaacctgggacacagatgttgcagtgggctgagatcacaccactgcactccagcctgggcaacaaagcgagactgagtctaacaattaaaaaataaagggcttcaagtgttatatgcttgttttgacttgtatacatgccagtagtgatgcctcatacagaacttggcttaccgaatgatcaatacacattaactctcttttttcctttcatatctgggaataaagttgatgaagctgcatcatctagcccaggaactagaatatatcttttttcttacattggtcagaactcagaaacttggctctgcttacctgcaagggcatctggtaaatatagtcttcctgtgtgcctgagagggaaatgaaatgttttgatagatacatcataaccctgtctttgctgtgtagggcttttctgctttgttcaatgttataatccaagcatctagaatagctcatacagtagttcctgctaattcatgagggacatgttccaaggccacagagaacgcctgaaaccatggatattactgaatcccatgtttttattttttaattattttcttagatacagcatctcaatctgtcacccataccagagttgtagtggtggtattatatgtcgctgctgcctcaaacttctggcctcaagtgatcctcctgcctcagcctgtggcgtagctgggactacaggcgcaagccaccacacctggctaaaactatattttcttttatacatgcacacctatgataaagttaatttataaattaggcacagtaagagattaacaacaataacttatgataagatagaataattataacaatatactgtactagacactatgtgaagatgatctatctctctcaaaatactataatatttttggaccataattgactatagataactgaagtcacagaaggtatatttgtggagaagatgggggactactgtattagactctgaaacatgcttattgcattagtaattgctatgatttgaatgtttgtcccctccacaactcatgtggaaatttgtcattataacagtattacgaagtgggacatttaagaggaattatgtcatgagggttacacccaccttatgggtgggacgggtgtcattctcaaaggacaatttagctccctttgctctctctgatcctctctgcccttccttccatcatggactgatgagcaggaaggcccttatcagatattggccagcccccaatcctagactttccagtctccagaaatgagagccaatatatttctattcatcgtaaattacacagtctgcggtatgctgttttagcagtacaaaacagactaatacagtaatgaaaaaggaaaatgccaacataaaatcaataataaatacaaggaattctgaaggaataagcttaagcatattagttattaaaataaatacaaacaactgaattctctcatctaaagacagatgttaggtgagcacagcaaagcacagctatctactgtttaaaagaaacacccttcaatgataagatggaaaatgaagggaagggagaagggatactaatcaaatgcatttaaaaaaattggaaaacataaagttaaaaagtagcaatattaatgagcagcgagatgcaagggaaggttaatgggatgaatcaggataaaatgagacattaagtaatgataaaagcacaatttatcaagatgatatccagccgttaaccaatataaacctatctacatagcaactaagtatatatggcaaaacatattagatttataagagtttgttgcaaacataattataattgaaacctccaacatatcatttgtcatagttaaatagatctatatataaatatatataagaacacaaataaattaactaagactatgaatgccataaatagctgggaatttaaatgaaattcctgcatattagcaaagaaaaataaatcacagacaatggcagaaattataaaagaaagctagctagctaatatgttctggtgagtgactccttttatgggcctcgtttatttgtttcaaaaacatttccttaagtgtctctttctaattaaatcccattatgcacaatgatggactctgtatttagtccttattgatacaatactgctgcactctctattaatccaaatatacagaagatgttgggagtcagagtgcagtgctggggaaagggctaaccccggatgccaaaactggttttgagtcctgcccttgttatcactgatgcaatttaaaatctctgatagttgcagtatgtatcttgaatcccaaactggagttcaagtttgagatattacttactagttatatgatcttggacaatttacttacccttattgagattcaacattcttatataaaaatggagaaacaatctctcgggatgcaagtctgtctacaacttaacaacattttacaggatagtacaaaatagttaatctcctaggatccaaaacgcctctacaatcttttttttttttttttccaaataagaagctgtatttgtgttagaataactaaaagactgatgaagacagtgtttgcaaaataaaataatgctttcctcaaaggaacaacaaaggattaattaaatgagtattaaaaaaaaagtctttgcttctatttctcaaatttcaaaaaaataggttggaaatttaaagggcttcacaggccaggagtggttgctcacgcctgtaatcccaacactttgggaggctgaggccggcggatcacttgaggtcaggagcttgagaccagcctggtcaacatggtgaaaccccgtttctactaaaaatacaaaagttttccaggcatggtgttgtgcacctgtaatcccagctacctgggaggctgaggcaggaggaactcttgaacccgggacgcagaggttgcagtgagctgagatcacaccactgcactccagcctgggcgataaagcgagactgcatctcaaaaacaaatagaaaataaaaaataaagggcttcaagtattacatgcttgttttgacttctatacatgccagtagtggtgcctcatacaggacttggcttactgaatgatcaatacacattaactatcttttttcctttcatacctgggaataaagttgacgaagctgcatcattgctcttactgtcataaccactgatgttatccctactcaataagcccttcctgaagaggccagatgatttccttttttacacttatgtcattattgaaaatgaggaattggtgatctacaaaataagttgtgatactggaaggaaaacgccaatgtgtgcttatacgtgtaaggcacaaggggattaaaaacatgcctgggcaggcaaaaaaaaaagggtgtagatgttaaaaatctttataggagaaagacagaagttgtgggaaatggataaactggaaatagaaaataaaaaggaaaaaaaacaaacagaaaataagtcaatgcaacatttgtctcaaacctttgcaatatatgagggagaaaagtagatatggaagagtataaatattttaacaaaaggaaaaaatgaataaaatgaaaagatacaacacagtggatattttatctaccttgaatatttctgtgaaatcgaatcacaaaaagtactaagaaggaatattaatgcaacctaaacttaaagctaccataaatacatacacacatatagcacactgagaagtgagtagacctcaaacttaaagtgcataagattaaccctgggaatttattaaacatacagctcatagaatttgcatttttatcatgcactgtagctgattctgatacagattgtcaacagtctatagttgagaaacactgtctggttgaactatacttcaacattacccccggagagatgaatgtcctcctagtattttcatcctgtttcatgggtgggattatagactcaggacaacttagagaactgaaaatcatgtttttagctatgcagcagataccactatactctgaatgaatactctgtatcaagcagaacactcacgaggcttttttctaaccagtggattttggctacgagagaaaaagagatagcaaacaagcttggcacaagattcagaagaaaagagacttgaagcctccctggaagagaagataagacaacctgcaatgcttagaggatatttaatttcagcattctgaaatttggggaattataatagcagatgatgattatgctctccacagatttattaaaatacattttaaaaaaatgcatttttatgaaacaaatagagcttactttaagggatccctgaatgattattatttttcagtatcaaatagaattcaaagaagaaagctgtttaatgttcatttatgaaggactgccaaaaattcaaaggtagaagattctctgcttgaaaaagcagaacaatcagcacaaatggaagattttgagagtaatgtcaagacggtgtgtgtgtacaatatgaagataataaaacaaatacataattgtaagcattgcatataatggggtataataacttctaaatacttcatttctaagaaaaggatatccacttataaacgatataaatctgaagttctcattacataaattctgcagtagtttggttttggagttgtggtgcaaacagaaccacatagaatatacaaaatacgcacctactatgagcgagattgtgcttgtgcttttatcaattaagataatgttcagctgcaagagccagaaaactcaattaaaccatggtttgagtaaattgtgggttttgtttttctgaagttgtgggaagtacagaggtgtaggagtctggggctgttacagcactgcagactcatcagagatccagttccttaagttcttctcatctaccatcgtagcatgtggttttccaaactcatgcagctgccttcgaattgcaggaaggctgctctgtccagcctccaggctgaagaaagagggcacccagcaaatggcatgtggcaattaaatctgtctttagaaagagcttttctgaaagccccatttggaaattatctgctccagtcttataaaacagcactgtgtcacatgaccaccctacatggtacaaagaaggctgcaaaattcaggattttagttggctacgttgacactttgaatagatgtggtacagtggcgagtagatatcaagtaggcaaatagcaatgtctaccaaattagatatattatctaatttaattgttttacaaattacatgcatttcatttcttcaatagatgaggaactgaaacatagaaatgttaagtaacttatctaaggtcaaacatggttactgaaaggtacagtctggtatgaaagcccatataattaaatgcgaatatcttttcccactatatcacattcctttaggtaccaccaagccaaatattttcagatggtaattttcagaaaaatgtgtatatcatgaatacttcagtcagatgtattttgatggtggagactacatttcctcacctgagactgaaaatttatttagggcaccgaccatgtcttcaacacttttgcattcccagtgcgtagtccagggttgtatcagtagaaaccttgagatgctggctaaatgtggattaagaaattgtattttaagctcacagaattcgacaagattttaaaattttatttattctaatatcctcacaaggttcacagagcatgttatagagtaggcattgagtaaatatttgctaactttaaataagtaattaaaatttgattttattgcgagatatcagagaaacatatatgcagagaaaaaagcatgacagtaaaaggagtagtttgtattagagtcatgagtttgacacaaagctcacagggagctggaaatgcatgaatggataaattggcctttgctgcacttcaatatgatgaatttcattgagtcactaaaaaatatttgttgagcacctactttatatctgacattgtgttggatgtcatagatacaatgaataaaacaacacaaacacgtccttgtggcttaaattttgtcttctaaagatgtatatgttatgtcctgcccaagactataggaatccaactcttgcatcaaggtaacccagatgtgaggacatggattcaaatgagatcattttggagctttatgatttgactgccctgctggatttcagacttgcatggggcctgtagtcccttcattttggtcaatttctccaatttggaatgggtgtatttacccaatgcctttacccacattgtatctaggaagtaactaacttgctttgattttacaggctcataggtggaaggtacttgccttgtctcacatcggactttggactgtggacttttgagttaaggctgaaatgagtaaagactttgggagactgtcagaagggcatgattgtgttatgaattatgaggacatgagatttgggaagggtggtaggcagaatgatatgatttggctgtctccccacccaaatttcatcttgaaccgtagttcccataatccccacatatcatggtgggagggacccagtgggagacaattgaatcacgggggtgggttttcccatgctgttctcatgatagtgaataagtctcacgagatctgagggttttataaagggtggttcccctgcacatgttctcttgcctgccgccatgtaagatgtgcctttgttccttctttgccttctgccatgattgtgaggccttcccagccatgtggaactgtgagtccattaaacctctttttctttataaattacccagtctcagttatatctttattagcagtatgagaatgggctaatacaagtcctaataccagtaactccaattaccttatttggagatggaggtctttaaacaggtaatcaagttacaatggggtctttagcatgggcgctaatcgaatataactgatatccttatcaaaaggggaaatttggacacagacatgcacatagggagaacaccatgtaaagatgaagggagagattggggcaatgcttctacaagccaagaaacagcaaagattgccagtgaaccatcagaagctaggagagtgacataggacagattctgcctcacaatcctgagatggaacaaacactgctgacaccttgatttcagacttccaccttccagaactgagagaggatacgttacttctctttaagccctctactttctggtgctttgttatggaagccctagataactaacacacagtgaagcccctgcctcacagagctttacattctagtgtggagcagaaaaggaaatagaaaattaccagagagacatggttattctttatatggtggtaaattgttaggagtaaagaaaagtagggtgaggaggataggaagtgctgctttatatgatgtgacctctgataagatgccatcaggagtgaaagaaggtgagagattgagctttgtaaatgtctgaaagaagagcattataggcagatgcagcagccagcccatggctctgaggaagaagaatgtattttggttagaagaactgctaagaggttaatgtggctgaattggatggagtaagggagaggggaaaggtaggaggagtgtggtcagagaagaccacatagattgtataggtccattttagattctgatggtgactttggcttctattccagagatgccatgggagggatgttcaaagcaaagggatagtgtgatctgatttaagttttaaagggatctctctgggctgtgtggaaagataacataggtagggagcaaaggtggaagcagataaatcagggagaagccttctgtagtaaaaccatccaggtgagagaagtggttggcttgaaccagcttgttggttggtagaagacagaaggggctacgtgaacagttagacaaagcattgcatatacaaggaaatgcttgacagaggaatggagacaagttttctagaggatgcttcaaggagtttccacttaggagaagcaccttagaggggacattgaatattagcactggaaggaagttggtgcagaagagaatttggcttgctgtagccatgcagtcatccagagcgatgaggttatcaaccattacaagattcactcctcccactcatgtctttgattgacatttctggtccccagcgtgctgctctcacattttggtccctgcaatgagcaaatgaatttcgtttcctctagtgaaagctcaatttgaacaacgggggaaaggttttatttaaatctcctacagctttgaactcatcttggattcaccatccatctgtcaacctgaaaaaagaaaaattacttaaaacaaaaattcaaactgaattgacaccaaataaaatatcaaatgctggtagcaagaatgatccaataggaagtgcttaacagcatgaaagctcaaaaattggttgaaaaattatttgcatctagctgtttaaatattttgtttagttgccatacaaattaccttattttagactccaaattttttaagagcaaaaaaaaaaaagaaatttaaaaacacagaagtttaaaataaagtaaaatgtaaagataacatgactttgagttcagtgagattgtatctaattttgaaatatagtaagttaattaaatagcttcttaattttgcagcaggaacaaatctcagtctacaaaatgtggggtggatgtgtgataactggccatagacatactgaatttaaagggtaaatacttgaaacctatcacctgagtttgaatcccagcactttttttacaagttgaggaaatttgttaacccatgcttcagctgcatctctaaaatgggaataaaaatagaaccgactttataatattgctgtaggttttcagtgagttaagtcatgtaaagtaaatagagtgactgccttgattaagccttaaaaacttaagctgtattattattttttattatttaaatttcctaattttctatttaaagttacatttcactggcttagagaaaagtgtaaacacatttcgtttatctaattccagcttcctgggatttgcatcaaactttgggaagaggcatgacttacacagggcctaagcattggtgctcttggaggacacggagcttgggggttgggcagattctctgtggtattgacgatccttgtcttattttcttctcattggagcaggaggcagggaaagaaatgcatggctcagcagcagcagcatgcatatttattgctgaaggtcttctcccagacattttggatttttttccatttgttaccttcacctagaaaatctttagtgtattaatctgcagagggcatctggtcctttgtctataccatgaaatctgttattctgtacctttatttcttctgagctaaggattggataacctcaaatatttttctctctctctttttattgccaagatctcccttccctaaggcaatggaagaagacatacaggagagaaggaactacaaataagagagatcaccttgaacaaaagttcgaaagtccatgaagctatatagtttttttctttttgaatttgttcatatgcttgatctgtgccaggaattgtcctgaaatttatgatataaagaaaaattaagcaaatcatttaattaaattgcgtactgtcacttggagaagatgggcaagcaaactaatgactataataattagagtggagtgtgatgagactcagagtatgtagatataaaacattccacaaaagaccatttgtagtagtgaccctctgtagggaaagatatgcattccaacattggttttacttgaagtgagttgataaaaatgaagcttaccagactgcatatgagcaaggcgggactttggaattggaaagggaatgtggggatagcactggagaagcaggatagggctgcagcaacactgatcgacagggaacactaaacaaggtggactgttttctgtgggtgaagtctgcgtgctttaacaaagtaagatacttcgtatcttaagaaaattagcactcgtaagtgggagtcgaacaatgagaacacatggacacaggaaggggaacatcacacaccggggcctgtcaggggcgtagggggaaaggagagggagaacagtaggacaaatacctaatgcacacggggcttaaaacctagatggcaggttgacaggtgcagcaaaccgccatggcacatgtaaacctatgtaacaagcttgcacattcagcacatgtatcccagaacttacagtaaaaattaaaaactaataatagtaaaataaaatacagctattaaaaaaaaagaaagaaaattagctcacctctctgaaactcagttttctcatctataaaataccatcactagcaaggatgctatgaggatgagggaggaggatgtcattcagattcccaaacctataatacgtagacggtagtttcaaggaaggatgtggattctattcgtttgccttggtaatggctaagtgatgtaaaattagaaatttctaaattcatccatacgtagcttctgacatctgcagaccacatcgaaaaggttatcacactaacggggtgccgagtggagtaattatttccagtcaaatatcttgaaaatacatatagaaagttaccaagactagaggagaaggtagtgggagcatgagggtaagactttaaaatacctggattcaactgagttcccaactaattattagacaatagtttcctccattgcagtcaacccttcctgatttttttctttttaaaagaagacatttaaaaaatctttttattggtgtagtcacttgcatgatggcctggtttgactgaggtgttagaatagggtaaggcaggattttaccttcctccaacccactgtaggtgatttgcaattcaatgagcaataaattatataattccaaatatggagtgtgtgtatgtgtgtattttaatggacatcttttggaaatgcccagaaaatctggaaaattatggcgccaaagatggcctgaatgaaagcattagtagaaattagtataaagtttttgcttagtcttgctttggctatgtgggctcttttttggtttcatatgaattttaggattgttttttctagttctgtgaagaatgatggtgatattgtgatgggaattgcattgaatttgtagattgcttttggcagcatggtcattttcacaatattgattctacccatccatgagcatgggatgtgtttccatttgtttgtgtcatctatgatttctttcagcagtgttttgtagttttccttgtagaggtctttcatctccttggttaggtatattcctaagtatttttttatttgtatttttttgtggctcttgtaaaaggggttgagttttttatttgattgtcagcttgattgctgttggtgtagagcagtgctactgatttgtgtacattaattttgtatcctgaaactttgctagattcatttatcagttctaggcattttttggatgcatttttagggttttctaggtatacaatcatattattggcaaacaacagttttacttcctctttgctaatgtgggtgccctttatttctttctcttgtctgattgctctggttaggacttcccatattttactgaatagaagtggtgagagtgggcatccttgtcttgttccagctctcagggggaatgctttcaacttttccccattcagtatgaagctggctgtaggtttgccatagatggcttttatgacttcgaggtatgtctcttctatgccagttttgttgaggtttatacttcccaaaagtatacctacaatgagaaagaaaattggtgggattatgtgaaaagattcaataagcattcacttgccatatgctattggaaaggcactagaggcggaagaaaatcacagttcacctaattaattatgatatagatatattgctactagttataatccaaggcataataattctacatgctaaatggagatcccatcatcattcatagaaaagtagagcaggtaacattatttcaggaaatcagggatagcttctggaggaattaggccttgaaagatgggaagagtttgttagaggaagacttgggagttcatcaggaaaaatatttaagctaatggaatggcaggaacaaaaagatgatgtgtgttgtgtacagggttctatttcggggagtgtgagcagaacagaatgcttggagttttggggaaaaggggagaaagggtgttctttattttttgttgtttaatctttcagtgatttcctatgaaagaactttaaaatgccagataccttctgcatttgaagaatgattttttttcacataagcagacaccattgtgtaaaacaaaatatagtaaacaaagccaaccaggctttaacgatggacaagcccgacttccgaagctacagtgccttgccactaaatatgagcctgacttgaagagtagttaacaaaatcattttttaaaaatgtgagttcatcttgtcttacctcacacagtttcttgatggtatcagttgctgcctaatttcctgagtcctaacctaagagtacctcctcctggttagggtctcaacttgccttcttagaatgaattcttttcactacattctcaccatggatcttctcttttcttaagtcatcagtaaagagattttctaccatatccactacattacagtatttggctgctctagatgaatatcttgggcagttggtccaggacttacaatcctctaccttgatcctttgggtagcctttctgtttggttcctctgtcttagacagatgggcaggagagggttcctcttctagtatcttcatgtcacaaggtgttatccatgacgggaagtgggggtgagttgtctttggcgtttctttagtggagtgcagctcagagcagtgtttcttaaaatatgtccatcattttgtgaagtggtattcgtcatgatgatattgcaatttaaattcagaagtgtgaataaaagcatggtattaaaacaatttatgaaccaaggcttcaatcattagtatgataactgcaaacacatatataaacacatggctgtttgccatgtaatccttctttcttttctttcatttctttctcttgagtagactttcccctattttattctaacccttccatctattaaccgtaaactcgtctgtgtgtcttttttttaaagagacagtgtcactctgttgcccaggctggagggcagtggcactatctaggctcactgcaacctcgacttcccaggctcaagccatcctcccacctcagccttcctggtagctgggactataagcacacaccaccatgcccggctgattttcgtattttttgtagaaatggagtttagttatgttgtccaggcaggtctcaaactcctgagctcaagtgattcgcctgcctcagcctcccaaagtgctaggattgcaggtgtgagccaccacgtccagctgtgtgccttcattgatactaatgtagattgaagctgaaaagataggaataaaaaaaaaacccagaacatgtggcagctattacaaagattgattaaattgatgttgttaaggggaaaaacccttaaatagcatctatgatagcattttagtgaccatggaaaatttaatattttttctgatagtggaccacttactcaagtgaatcctaaattatatacaaaaattacgtaacaaagacagccatgagttggaccctgttggataataatctagtgttttctagattccagaattgtagattcaagtgagtagaattggaatgtactttgatttgggggagttttctggaaacaattgtggatatcgtttttcaatattgaatgagttgccaccagaggtgtcatgttgcttggaatcatcaataactcagaagtgacagagaacagcctgggtatgctctgaaagacatatagatgtcacatgttgagagcttaaccagatggcatttttactcatgcaataaatacatattgagtgtccacaaaatgtcagactctgtgatagggtggagcaatgaaagagtgagaaaaagaaacaactacccttcagtcctgggatttgagattttttcccatcctaggaatctaggaatctacaaatatgaccttcagttttacacagaagcttctttttttaattgttaaatggggctcagttgcactactttacagcctaattttaaaaattagataaaaggatatgtgggctgggcacagtagctcacgcctgtaatcccagcactttgggaggccaaggtgggcggatcacttaaggccaggagtttgagaccagcctggccaacatgggaaaaccctgtctctactaaaaatacaaaaattagctgggcatggtggccgtgcctgtaatcccagctacttggggggctgagacaggagaatcacttaaacctgggaggcagaggctgcagtgagccgagattgtgccattgcactccagcctgggagacagagcaagactctgtctcaaaaaaaaaaaacaaaaaaaaaaaaaaaaagaaaagaaaaggatatgtgtagaagtgcccagtgacaaaatgcaagaattttagaaagttgataaaacatgagaagatcctgggagacacatgtgaatctcaagagcaggaactctagtgtattcacctgtacacagttactatcactagtgacagaaacaatagagaagtattttctttctgaatgaagaattcttctctataatggtaattcctattaaatcctttaatcggtaattgcaaaaatggaataagatttcagtctaatgctccaagatgtttgcactgcaaaattctacccattatttagtcaaaatccatctctgaggagcagcctaagcaaatgatctctccttaacctcagttgaaaccttgtcatgctatttcactttgcttagcagagtgctcatcttgagtttgctgtataccaatatgggggtgcagtctccatggctgcctgcttctccccatcctttgatacaaatcaacattcttgtttagagaatgataagagattattaaattcaggtatcagcagtggagttttggggaagaaaaataaagagatcatgctctgtaacacagccctgagaaaggagactggggctgtgtgctttctagaaaagtggttttccctcctgcatgactgatggcctgtctggtgtgaggctgaccatggtaataatgtcgtgacctactctccacagtggaaaaagctgtcggttctgatgtgatggaggttgggtgtgggagattgggattacagaactgcagtggccacagatagactcctgatttagtcacataaaacaggatgattttgtgtaaaactgacatttagtttattttacatatatggaaggaagactaggaagaacataaaacaattagcaggaattacttctaagagatattgagggaagtatcaatttcttttgattaatatgattttttacattccactttttatttgtgaagatgtataaatctaaaattaaatatacatgcccacaaaaataaaattatgtatttagtgacttagcgtaatttcataaagggagcatgaagtttagaatcagccctgcaattaacatcctaaattttgcactaaggataaaatgcttgaaaaaggatgaagtgataatatccctttctttttaggacagacattctaggattgaacacagctcctggaaaggagcttttctgcctcgctcaccaggagtgtgctcacactcttgacagttccctgtgctcctttcccactgtgggatttaaggccaaagagattggatctggctgccacactccttcctgctgccatattctcttagtgaccatcaaatgtcacgtcccttgttgacacagcactatgctctggaagcctttgttgaaccctattccgctgtcctttgacccttttactttttgaaatgtatatattctgtggatcccatgttttgttttctagcctgcagcttccctcagcaactacagccagagccagccccattcccttctcccctcctaatcagaactcttaaagtctactccagtctttcttagcttgcctgttttgctgtaataaactgggacatgcagggcaaagtctcaacacaggacatctcagcatcttgtccatactcttatctcggagcaagaacacacggacccactgttgatacctgagacaattatatttctttacaatgattttagaaactactagagcatgatgagctcaggtgttatggttagcaaatgtggaagactcaacttgccttcctcacaaaacctatttgctcttctcagttgcaatggactacctctacctggagtgtcaccagtgaaaaagttacttgacagggatctgtgggtggaatctacagagtgacagatttcagttcagttattaagataaagcatttataactgacatgttttgtaattgagtgggtggtttgctccacattcctatggcaagtatttcccagagcaggtaccttatatcggtagtcccactgggggctccatgacaacgcagctgttttcatcaagttggaaacgctgtcactgaattactgcccatggactctccacatacctaggagggaattgggggattcttgcagcagagaagcccatttaacttcaaggcagtagtctaacttttttttttttttttttttttgagacggagtctcgctctgtcgcccaggctggagtgcagtgacacgatctcggctcactgcaagctccgcctccccggttcatgccattctcctgcctcagcctcccgagtagctgggactacaggcgcccgccaccacgcccagctaattttttgtatcttttggtagagacggggtttcaccgtgttaaccaggatggtctcaatttcctgacctcgtgatccgcctacctcggcctcccaaagtgctgggattacaggtatgatccaccgcacccggccagtagtctaactttttaaaacacagatcaatattttcctggaacatgcttttccatatcccatagaccagggtttaaatgatcacacttgggacccttgtatgatcagaatcatctcgctccgttacttttagcacagggctgatgcttaaacccacattgtgtcgctttgtcccagggctgcattgcagtgagttcctgttcataggctgggtgacaagttaaaggtggcatcctgagattggaatcaaggcaacgatgttttcgcttgctctgttgcagcctgcccacctcgggggaatgtcagcagcccctttttgtcagcatataaacaagaggttttgaattgttcagtcatagagaattgtgaatgcgttagaaacacccaggccttaaacttcggttagtggttagataagaagaaaaagttcaagggaactattgtacaatgcggcaactatagttaataacaatgtatttgctaacagaatacattttaaatgttctcaccgcataaagataagtatgtgaatgcgtatgttaattaacctgatttagccattccacaatgtatacgtattccaaaatatctggttttacagcataaatttatagaatttttgttaattaaaaaatgtgggcttcaaatttccaagtgttttccaggaatttttggtgttaaaaaaaaacattcattttgtcttgctagacaggtacctagtcctaaaatcttaagaatgtttcagctctgcagcagagctgctggcatttattaagtatgttgctagttgtaagatcatttggttcaatgttgggcatattttcagactcaacaatttatattttgcttgctgtatgtgcaagcaaataacttcaactaggccagcctcgttgtgaagaaatttccccggtaaccaatgaagaaatattaatgatttgccagttggtctcctcggagacagataacagttgtcttcctttgtctgccccgctacctagcttatatttggcacttcatcaataaactaggggtgagaaagtaaataagtggtgcttctactctgcctgaggatacttgaaagcaacttgttctcttaagtggattaaataattcctccctgaagatctcattacttgataattttgtaaaaattagctttttctttataggaagggggtaagtaaactttgagtataactggtagctaagagccaagccggcctaggctccatcatgttcccagcacttatgggcaatctggtttagagaaagttagttcccctctccgtgcttccgtttcttaccagtaaaatgaacattacaacaatcttataaattgctgtgagataatatttaaagcagttcctggtacgcagtaagtgctcagtaaatgttacccactactgtataatccaaaggtgggagtgttccaaaacaaatgctaattttacaaataaaaattttggagtgttaaaaggaaggaagttatatgttcaaacatatgtatgtcatagataaaatcaaactgtttttgcttaaactatgtgcctcttcttccaccctaatatctgtgcagtacttgacacatagtttgctgagtgaatgaatgaactattaattaattaatcttcacctgtatcgcttgatgttttcctgcaggcgtgaatatccctgggcatactgcttgctttgagaaatagccagtgaagggttatgagaaatagtgcgatttatgatctgtgtatgactcaaatgacaaaattaattgcttttttgtcatctgttcttcatggattttcattaattcttccatatgaaccaaatcctgtcttaaaccctgcagtaatgatcacggtgtttaacattttaataaaacgatggaagcatgtatgtgtgtgtgtctgtgtgtgtgtgtgtgtattcatgacaaagaaagtgagagagagagaaagaaagagaaaaataatttacatgagagttaactttttatttgtatgtccagtggtgtcagttgccatgaataagctattataaaaaattaataaataatttcccattaaaatacaaaaatataaatgccatcttccttgagagtatttctgaaagttaaaaactctaataattggataacttttctgttatgttaaaagaggacagtttttctttcccttaagaagattcctacttatcctattcagtgtttgaataatttccaaattttgatttctgtctctgctactggtcataaacatattgaggtttcaaaacattcagattggccctccattaatcaaacatgccactcatttcttagcacaatctacagattcacaaagcccgatgctccatatcccttgtcacatccggaggcagagcattgaagttcatggaagaaggaagaaagccatgcctgagttgcacctgccagcaaaacagatgacaggcagccaattctgagccatctcagctgcaccggaaagttcttgttcaaacaggctgtatctaaagactttctaattaccctctcatgtcatggaacacctgtggtccactgtttgagatcctctgctccctgatttctgtacacttgcctctcctggtttccttcctgcaacctcctcttctgtctatatgaaaaagtttagtttttattcccagctgttcacaaatattatttttagtgtaatgataggtaatccttattttaaatgtcacaactctagtctctctccaatgtcctaggtaccacagtcaggaagcttcctatttgcataagaatgaaaacatggtcttgaggcaggataagtaaggttaggacccatacttacttgtcctgtgtgtaaagctcagtgggccacttttatagctggctctttccccttgcaccctcaggcatcaacacctaactcttttgcaagataagcggtcctaccgaataccaacagactgttagatggttacaagttcctgatactcagtatgggcttggggaagagaacaaaagtctgttattcctgatgtaacttccccagcaccaaaagcacaagaaactattagctacaaatttctgcctgctgggcactgagagaggggcagagactcctccagtgtcccacaggcatagctagactcaaggtttagcttatagtaatatttttctcattttaatatcaaaaaacaccccttagatggagattttatatgctaatgatacatatgatatgtgttagagcatgtagatcctgagtgtatgtactaaccacagatccacctttacatacttgacctcaccagtattttatgaatatgtctgtacagtttccgtaaaggaaattcccttcaagaccctaggggctatctctgtctttgagcagcccactctgcctctcagattttgagagctaatcccaagtaagagtagacaaacaagtttgttgcacctcactttgcaatactttcgctttgatataaacttctttgtctacacttacttgggattcgctctcaaaaccttttgtgcagagaagtcaacgacctgaacaaggctactgacaatagtcttgccaaattttctacaaactccattcttctttatttttattttattttattttactttaagttctgggatacatgtgcagaacatgcaggtttgttacataggtatacatgtaccatggtggtttgctgcacctatcaacctgtcatgtaggttttaagccccacatgcattacgtatttgtcctaatgctctccctccctttgccccttaccccccaacaggccccagtgtgtgatgttcgcctccctgtgttcatgtgttctcattgttcaactcccacttatgagtgagaacatgtggtgttcagttttctcttcctgtgttagtttgctgagaatgatggcttccagtttcatctatgtccctgcaaaggatatgatctcattcttttttatgactgcatagtattctatggtgtatatgtgccacattttctttatccagtctatcattgatggatatttgggttggttccaagtctttgctattgtaaatagtgatgaaatgaacatacatttgcatgtgtctttatagcagaatgatttataatcctttgggtatatacccagtaatgggattgctgggtcaaatggtatttctcgttctagatccttgaggaatcgccacactgccttctacaatggttgaactaattacactcccaacaacaatgtaaaagtgttcctatttctccacgtcctctccagcatctgtcgtttcttgacttttaatgatcgccatcctaactggcgtgagatggtatctcattgtggttttgatttgcatttctctaatgaccagtgatgatgagctttttttcatatgttttttggtggcataaatgtcttcttttgagaagtctatttatatcctttgcccactctttgatggggttgtacaaactttattctttgtattgcacattctctccctcctaggagcaagtttatgggtccatggcctcttcatccagtgcacattttctgcttttccattatagcacttattacaaagaatgaccatagctttttctccatggtctctcattcatttctgagctacctgagaacaagaatcctttctttacatgaaagtgtgcctgatatctatcaccatgtgtatgatgaccacagagtaagcagtcaagaaatgccagggaaataaatgaatgcatctactttttagaaacattgtcaccatctttctttatgtaattaaatgtgaacggttcataaggcaaattgataaggatagaaagtagattagaagttaccaagggctgggaggagggatgaatgaggaattatggattagggggcacagagtttctgattggggtgatggaagaatttggaaaaaaggggtggtggttgtacaacgttgtgaatgtatcaagttaacaaaagtaatggcaaaaaccacaattacttttgcaccaacttaataattaatgacactgagtcatgcacttaagcatggttttaatgataaattttatactatgtatatatatatttttttccaaataaattttttaatgacctatttacaaacacaaaaggcattgaaatctgggtaactagatgcatgttttctaaaaggaaaagcttatttgctaaataaagaattcataaaaggaagctcagcaattagtcttggaaacaattacaatggtagcaatagttttttcccttattctcacttcagacaaatattatggcaacagaaaaaaatgttaattaatgcaatgaattttaaaagtgaatgagtgaataactgaatgattaaaaaaagaaccatttaaatagaggaacatctgaggttgaatacttgggtccagcccagtacagttcattgctctgctgatcaggcagatgttagctggtcaggatggtttgcattctatatgcacgtagaacagacatggacacacatatttgtgtttggtaggatgggctgtcaattcgaatagtcatggggcttaacggtcagatcaaccaaattggtgccctggaagtgtctcagattttgtaacctatgtaagagttttaatctcactgaagcacagttttctcatctaaaaagtgaaagagagagagaaaaaagtccaacatcattgctttttttgtggaggtaaagtacacctgattagggcctggcatgcagaaattccttgcttattcacttttatttttattatagaggttcaaataaattcatgttgaacaaatagttattccacataaaatattatgcattctgaaaagaatattagtgccagatgttcatggtataacaatttttctttttctttcttagctaaatttatacttagcattcttcatgatgtatgcaatattagttcatctaaaatctaagctatagctcagaggctttgggggaaatactcatcagtgttcagagtaactctactgttggtgatctgtaatgtatcttttctaagcaaacataggggttaaaattgaggctgtgccttgccttggagggttagtcttatgagcactgatttccatgtatagagctttttctaacctttttctctttttctcttccccttccttccatgctgactttggtgtagcagaccacttggggattgaattcatgggtaagactaaacaatttgctcatttaatatcctggaaatgctaagctttatgatgtacatagtgctttccttctccatctggttataattgaaatgtctcattatcagatgctattagtaggaaaaaatactcttgtcgagttttcactaagtaatggctcaaaatgaaataattaactacttattggaaaggcaatttaatgttaaatgcagtgtctggaatcatacagaagttgtatttggctcctggctttgattatttcctctaattctcaattttcatatctgtaaaatagggataataataggttctattttcctgcacatgtaaattgcttagcataacgtctgcaacatggcaaacactcaataaaggataaaaagcaatggtttttaaatgtcagtttttaaatttttacttctaagtccccttccttttgtgagatgattcctttggatacattttggtatcaattttagtttggagtgtgggctattaaacatttttattcacaaaattaaaatgtttcctttaaagtatttgcagtgaatggtgtatgtttcaaagcattagaatgccttccatgggcattgtttttatagtcacagataactgcattcaaaattagacctaattctctgagtcgatggttatacattaaatgaagaaagaacatttcataaagttcaatatgcatcgtagtacatggatggaaagacactcaggatttagagttagggaaattgagaagatctaaatttgaatcaaaattcatctgcttctttggattctattaaattcagatttttttctcttgtataatgtggatatgaatacttgctttatacatgaatgtttattgtgaaataattatatacttacttgtattaatttatccattcacccattaattcagcaaacacttatcaaagtgttgatttgggatagctttgacatatttgagagacgttaagttggtggttgtattgttggaagtgttgagagttaattagaaatttgtgaaatgtctttataccggaattggtgttcccagttgtatggtattactcattattgctccattctctggttattacatcatagaaaaggcagacagctcaattcctgcaggcttgcggttttgttggatagatgtgatgaaaactcagaaaaccaatgagatttaggatgttattcaaatgaagcgcgatggaatgtgagatagttgtagaaggaagtgaaagaagaatgaccgtttcaatgaaatcaattagtagtcatcatgagagcgcttgaacaagctggtgtgatgaagagattatagtcatatggcagattggttgattttgattttgaagatggaggagttataggagatgacaatattcaaagcattcctatgagtgtaaataaccaaactgaggttgagggggaaataatttgaaactagaggtcaaggacttgagaggacatagttttggataagttgtctaatggatattccagttactcatgataatgctagggttgggacagagagaaaaaaaatgttggttatatgccaaagtttcccattaatatgataaactatactggaatttagtagatgacaaggaagagtatagttaagggtaatgccagctgcatcaaaaaatagagcccacgttattataatggctcaaagacggtagcaatttatttcctgatactactttttcttgtccaaggtagatgtatttcctgtttaaggtagcaaatgactagttttattcaagtagtgaattagagatccaggcttcttccatcttttggtttcaatattacgtaggtttctttgttaactgcatctagccagcagattgagaaacagaacagagctgatgcatacccaatgcttaaaagactgatctacaagaactcatatcactttttgcttaatgttctattagctagagctaaattacatgacttcattttgctgtaaaagaggctgggaaatggaaccctgagagaacagaggaaatgcatttttagaaatctctgccactgtgtgaatggcataaactttaaaggaacaggatttttcataagagacaagagaaactgtacgttagaagccaggaggacagatctccaatgttgaaagtgagaaaataaaaacagctcttgagacaggtagaggaaaatgagacttttcaggcaagattcaagtttcagctaaaataggagaacaaaaataaagagtcaaagaagagattgagaatgcagaaggtgtgttgcggaatgtggatgagcaatttcactaagccaagtggagggtataactggtggaagaggagtagatagctgagtcatgggccacaaattactgaaaatcatgggcatatttttgcagtaagaatacattgttgagaagggcacacaatttgtaccctcctcattcgctaatgatggcagtgattcgtagcatggaggtgtgagcatcagtactcattttgaataaaatgtgccctgggccgcttgtccaagagcaatttgccccactagtctgtggtgattgcaggctcagtgaggctttataagttgttcagcagaatgccctcaaatgcaggaaacactgcatagttggtggtgggactaggataggtctagatccccagtgtagccatggctgtagcaaactaaaattgccatgcaaattttaatccgtgttgaaagaaatggaccagtctccatcctgttgtgcttcctattgtgtctgaggactgccagtggcactggtaatttatagagttataatttgctatagatgcaatctatgtattaagagctctgttttggaattcatttaaagaaatgtagctactgacacaggaaaaaatagtagattgtcatgtagttcatctacatgaaccacaagactaaggtaatagtgagttttgcaaaagatagattctaatcatagctataagacctcatggggaatgaattctcagtgggtgactatttgactccaacggtagaaattttcttggagggaaggggttggggaacaactcagagttcaagggattggctggtatgcatatagataatggcagctaaaaaaggattgtttgcagtagtgaatagctttataaatttagtgaatatgctgttttcactgacctcaataattcacccccacagattgttctaattgaatatgtaaaattctgtttgttgctttgagaacaatattctcagatttaacttttttatttttattttttgagatggagtctcactgtattgcccaggctggagtgcagtagcacaatcttggctcattgcaacctccgcctcccaagttcaagagattctcctgcctcagcctcccaagtagctgagattacaggcgcctgccaccacgctcaactaatttttgtatttttagtagaaacgggtttcaccatgttggccaggctgttctctaactcctgacctcaagtgatctgccctcctcagcctcccaaagtgctgggattacagacgtgagccaccacacccggctagatttaatttatgattatagaatccatatgggtaaaattccttccactgaaagtgccatcatcccaagtaatatgacatctctaggtatgaattcagctgggaaggggaaatgtaggcatagtctatatgtaagtttaataatgtcagtttattgttgtgccaacaattaatcaatgctagttctatttgtgtgtgtgtgtgtcaatttctttaatagacttgattttcacacagttttaagttcatagcaaaattgagtgcaaattacagagatttctcacgtatcttctgtcttcaaacatgcacagctacctccctaatgaagatctcctacaatagaggtacatttgttacaattgacaaacctaaacctacattgactcatcattatcattcaaagtccaaagtttacattatggttcattcttgatgctatactttctatagattcagacaaacatattatgatatgtatccattattatattatcctacagagtaggtttactgccctaaaaatcatttgtgttctttctagtcatccttgcctttccccaaccactggtcttttttatttattttattttattttattttattttattttattttattttattttattttattttgagacagagtttcgctctgtcacccaggctggagtgcagtggtgccatctcggctcactgcaagctccgcctcaggggttcacgccattctcctgcctcagcctcccgagtagctgggactacaggcacccatcaccatgcccggctaatttttcgtatttttagtagagacggggttttcaccgtgttagcccggatggtctcgatctcctgaccttgtgatctgcccgcctcggcctcccaaagtgctaggattacaggcgtgagccaccacacctggccccactggtctttttactattgtcatagttttaacttttctagactgtcatatatttgaaataataccttttgtactggcttatttcacttagtaattttctcatgtgttttcattgcttaatagctaattttttgtatttttagtagagacggggtttcaccgtgttagccaggatggtctcgatctcctgacctcgtgatctgcccgcctcagcctcccaaagtgctaggattacaggcgtgagccaccacgcctggccccactagtctttttactattgtcatagttttaacttttctagactgtcatatatttggaataataccttttgtactggcttatttcacttagtaattttctcatgtgttttcattgcttaatagcccatttctttctagagctggataacattacattgtcaccttttgaaggacatcttagttgtttccaacttttgacaattatggatataattgttgtaagcatctttgtgcaggcttttgtatagaaataaattttcaactttttggtgtaagtaccaaaaagcatgactgctgggtcatatgggaaggatatgtttagtttttttagaaactgccgaactgaattccaaggtggctgtgccattttgcattcccaccagcaatgaatgagagttcctgttgctccacatggtctccatcatttggtgttgacagggttctggatttgggtcatttcaataggtatgtaatggtaactcactgtttcaatttggacttcactaatgacacttaatgtggagtattttttcatatgcttatttgccatctgcatattttctttagtaaggtgtctgccaaggtctttggcccattttttaatcagtttgttttcttattgttaagaattctttgtatttttgaaaaatgatcctttattagatatatcttttgcaaatattttctgtcattctgcggcttttccctttattctcttgacagtatgctttgcaaagcagaaattttcaattttaataaagtccagattataaaatcttccttttatgtattgtgcctttaacactgtatccaaaaagggattgccaaatctagtttatctaaatactctcatatgtgatctgctaggagtgttatagttttgcattttgcatttaggtctgtggtttattttgagttaatttttgtgaagagtgtaaggtctgtgtctaggtgcatgttttattgaatgtggatgtcaagttgttccagcaccatttgttgaaaagtttatcttttctccattgtattgtcttttctcctttgtcaaagatcagctgactatattaatgtgtatctattctgagttctttgttctgttccattaaactatttgtcttttttttttttgccaatactatactattttgattactatagctttataataagtattgaagtaaagtggggtccgtctttcaactttgtcttttaatgttgtgttgacttttctggatctactgcctctccctataaatgttagaatcagtttatgaagatacacaatgtaacttcctggaatttttattggaattgcattaaatctataaatgaagttgaaaagagctgacatcttgacaatattgagtattcctattcacgaacatggaatatctcttcacttacttgggttttattttttaagtctttcattagtgttttatcattttatttgtatacatcttttattttgctagacttatacctagatatttcattttgggggatgctaatgtaaatgctattgtgtttttaatttcatatcatatttgtttattactggcatctaggaaaattattgactttacatgttaacctagtatcctgttacattgatataatcatttatttgttataggaatatttttaatttttaatttttgttaacctaagcaatcaggtcatctgcaaagacagttttacctcttccctttccaatctgtgtacattttgtttccttttcttatcttatttaattcgctacaacttccagtatgatgttgaaaaagaacaatgaaagggggcaactttgcctcgttcataatcttaatgagaaagctacaagtttcttatcattaaaaattatattaggtatagatattttgtagatattcttcatcaagttgagaaagtccacctctatttctagttaactgagagtttttaccataaatgggtgttggattttgtcaaatgctttctttaaatctattgatatgatcgtgtgatttttttagtctcttgatgtgatggattacattaattattaatattgaaccaactttgcatacctgagataaatggataaatgtcacttggttgtgttttccattgttctattttaattagttacataatacattttttctcttacttttattattcttgctttgagcaatatgactttcatttattcttgaagaacacagggtcacaaggaggtaatgatctgaagcacacgtcttcttcccaaatctttatactctcaatgaccagctctattagtgagcttactgatcagtctcaaaaccagaatacttcatacagtttaacaaattcctgttttatagcaggaaactccaagtcatatgctgcaagagttctatatttaattgacatacatttgtcacatttactatatgccagatgtataagatgttggatatgcagatatataatacatatctctggatgtccaaaacctctaaaactaaaaagagaaagctacacataagtgaggtgacataataagtgctctaaaaaaagtttaggcaagatacgatatgaaaaaaaaaaagaaagcaattgaatgggcttggaaagttcaggaacagctttccaggaaaggggacacttaagctgagtatcagccaaagtggataagctatacttagtaatgccatagtgcaaatctataccggccccatattgctcccacattaaagcaagacttgctatttcagtctttcttcctgtatctatcagcttccgagagtcaccactttaggaccggaaagaggataacaacttcagtaaaaacaagtaaccaaaaaggtttttgagtagatttattaattttaaggagtgattatcccattgaggaagccatgccaaacctaatgtctgtaaaactgtcaacattcaacatgatttttcatttatattcccgaatttttcttaatgatgctcctgggattggtaccatggaaatttcaacagcaaatactgatctgcaatacggtgtcagttaaaaaataaagttaactgacataattagagcagaaatttggaaatgcacacagaagcagaattgtgtttgtgaagtttttgaaacaaagagagttgatagaaaatcagtaaccaaaaatatatatcttaaattcatgtcttaacctcattcattcattcatgcatgagggaaaatatagatttttacagtcagatgtttgaaatttccttaacagtttgaatagatcaagagatataattgacagacttcttcataagcctaaatattcatgagtgatgtgagaaacaaccaatcatttagtttaggcagttggccaaagggcatgtcagactggccattttggaaggtgcaataatcacgaaggatttcttatctaacaaatatctagctactgtgtgtgaaatgtatctcattaggtccttttgagctatttgttaagtggttatttttctaacaatgtcttgatgcatttgatgttccaggcatcaaagatgtttatatgaaagcaggtgcaatgccatttgaaaatgtattagcaagggacaagtagagttgaagattatgtggaagatctttaatgcaaatttccttcattctcatcgggtaaacgaaatgaatgctgtcagttaaatattttgtcggtgatttgacattgtttttaggatagcataatatatttatgcaaagtattgtttgagcaaattctggtgtaattttttaaatcaaaagatgtatagaacatagaaaaataagattcttaattaaaatcttaaaaagttattataagataatctttgtattttttaagttaaaaaaaaaaagaaacagtgttttccatatggaaggcatagaaatgtgttgtactcaacgtctgtgatataaattatatttataggtttagaattgatagaatattacttcaaacttgatcgtatattgggtattctttcatcctcttgtgtaaagaaaataggctttagtgtattttagtgagcactggggataatctcctaagaagtgaccagtttaggatcctgtttagatgataggaagtgggcttttttcttcttagagctaccctgcatattgtaaatgacttggtgtttttcctttaaatctaacaggctcatatgtcagccaaatgaattcatatttctgttctagtttgtgaactggcgttagagatagaactgaggattcttttttcctaagctgaagtctctgaagtagacttatttggaaaaaaaaaaaaaagcattttcattcatttgaatatattatatttctgtatagaataaaatggtaatttatggatatatatgcatagatgtgtgtttgtggaggagtgccattaaaagagtttagttttgctagtgtgccctttgccatgttaaactacgtgagaaatcagatatagtggaaaaacaaaagttacatgatcctttaagctctcaaaatgagtgaatgaagtagtaactatttatatcgctatcttacaaatgacaaaacctgactactaattagctgaattatctttctaaagagcaacaaagtagcagataggagttgaattcaaatctgtctttctccagagctcttgaattatttaggtgactaatggatgagcaatagggctccatgtttcctcaaagaggttgtactcttgcagtgtttcaaatggcaaagcagttctgtgactagtccttagttttgaaggtaatgttttctgaatcccttcatgtcataaggatcttggccagtaactcacaattatccaagctacaagcaaatgaaatatgaaccagatcctgtttatagctatatattcagaattataactgccaacagtataaaaaggaccacttagctggtcattgtattctctcacatggggtaatctacagaagttgtattgtattgaaggttttgtggtgagtacagactgtgttgaatgaagtcatttgggtggttctactgtacatgccattggggtataaaggccttactcatttatctcctctgatagaaaacatttgccaaattaaatcatgatttgaaccatctctccactggctcctaaagattctattggagaagtatttaatacttacacaatattgttttctcatttattttattttaaggaatatgaccactctctttctattttttatttttcaaggcagggtcttgctctatcaaacaggctggagtgcagtggtgtaatcgtggctcattgcagtcttgacctcccaggctcaagtcttcttcccattttaacctcccctgtagctgggaccagaggcatgtggcaccatgtgcagctaattttttatttttttgtagagatgaggcttctctatgttgccaaggctggtatcaaactcctgtgctcaagagattttcctacttcagtctctcaaagtggtaggattacaggcgtgagccaacgtgcctggcccactctctccctttacactttgattttctgttggtttattttaacatgggcttcagtacatgcgctgttaatcacaagccctccaagtattttgttttaacaaagttatctttatttgacatggacattccaaagactcccaagccatacatataaggataatattttggcttaattattaagagtagtcattaacacatattggtacctcctattgggagaagtaaaagtgtttacacaaagtcatgacaactaagtcaaataaattcaattctgagataattttcgggtgagattaatagtgttcagtgatctttgaaaatgatacaaccaaaagatgtattgaagaagtatgcagatctattaatcatgatttctacaaagaagaacatgagtatttctgtaaagatgtttttggacaagattttaaaatcagctaataaaatttgattggtagacactgaggaaagtattgaactattggcaaaagcagtgctgttcactgaagaataacataagaccaatacatctttgctagattaatagtataatattttccgtaaagttgttaaataactagattggaagtttctacgtaggtgtgaatatatggactttagcaaaatcttgggcagaatttcatgaatttcttatgtaatatggtgaaacattaattatgtagtaattatatagtgatagatagatttggggcaatgaattctagttgaaggatcaagaccagccatgagcagagcttctagtttcttctaaggaaacatttttatgaattgaaataagggtatagcttgaacatttaccaaattattgaactttttgtaaaaagtgaatgcttctttgtcagagagcaagtctaacaaaaagcattggacattggacttatcaaatcagacacagaataatctgatcttttagtcagtatcaagttgattacttacatatgccaaatatctcaactgcacgtgagttggtagtaggttctgaaaatctgggatgtgctaaaataaagggaaataaagagcaacagtgatgttcagattgtacttagaaagtaattctcagagagagccaggcatggtggctcacgcctgtagtcccagcagttgggaggccgaggcaggtggatcgcttgaggtcatgagttcaagaccagcctgaccaagatggatgaaaccccgtctctaataaaaatacaaaattagccaggtgtggtggtgcatgcctgtaatcccagctacttgggaggctgcggcaggagaatctcttgaaccctggaggcagaggttgcattgagccaagattgtgccactgcattccagcctgggcaacaaaagtgaaactctgccaagaaaaaaaaaaaaaaagaaagaaagtaattctcagagttatcagagaagttaaaaaattgttttttatatccaattctgccttacagttgcttcaggagctaggataagtcagcttaatagaaaggggaagaaaggacaatgatggaacatctgcagatgcagcaaagtgaagatgatacaggttcttctcaataagcagagtctgtctgctttgtgggctcatgatggttcagccagtcagaatgtgttgagcccctgtgagagctcaggccttgtaccaggccagctacaataagtcaaatgagacagactctcaagaagttcacagttcagtgcatagggcagactttttttttttttttttttttttttgaggcagaatttctctcttgttgcccaggctggagtgcaatggtgcaatcttggctcactgcaacctctgcctcccaggttcaagcaattctgcagcctcctgagtagctgggattacaggtgcctgccaccacacccggctttttttttttttttttttttttggatttttagtggagacagagtttcaccatgttggccaggctggtcttgaactcctgacctcaggtgatccacgtgcctcagcctcccaaagtgctgggattacaggcatgagccacagtgcccagccacatgggacagacttttaaaccaattattgcaattcttgcaaaaaagacttaaattgaagttttgttttgttttacaaaaggtcagatgaagatgtcccaaacatatacaggatattaatatatgtttgacacacatgaacataaataggagttgagttcacatacatgtggaaaacattaggttctgtacctctactgcatagcttcacaaagtcttaggtgtattctattcatctgtgaatcttggagagaaatctattgtaggcaaccttttttgaactatttgtccaaaggagcatatatgctagagctacggtttagggtaaatcctgggataaagggagacagaggaaggagcacccacatacatcagaatagttcgggccatttttaagtgaaagaataaaaaattatatttctacagttagtagctggagaaaggaaatatgagagagagggaaaaggaagaataaagggaaataagagatggaagagcacatttgggaaatggcaaggagtcccagaactggacaaacttgatgtagttggtgaaggggccagagcagattatgaccaccctatctgccctttgaaataagtataatcttatctcttgttgaagaagaaaaccttctgaggtttcaagcagggaagtgatgagattttcttaaacagcttactctgtcagtagctgtgtgcagagtttgcctgaaggcactgatcgcagaatcctagctaatggaacaaacttgggattttacttcaaatattcaccaaatgctagccctttaagcaaccctgtggacattagaaggataaattttcatttagtctgtgccagattcagagaaagcggcaagtgcagaatgcctggggaggcagtgagatgagttgcaaagtggaccttgaactggtcttcgaggaaagagcacttgatttttatgggcagcgatggaaacatcctaatgaagatgtcagcgtaaacaggacgaggatgaggcaatctgtttggaaatactggctctcatcagcaaagggaatcacattataatttaatttggattacatataactttttccttaaaacatccataaaagcataccattcccctgcatgaaactttttaatggatttagaatgaaatctaggcactatctgctgccatgccaagtcctccatgatttggctctgcctggcaccctgaccactcctaccacgttattattctcatttctctacctaccccagggcctttgtcctgcctttccctcagcactagctattgtacttatctgcacgtggttgattccttctcataataaataattcaattaaatacattctgtaagagacttagcctctctattttatgtacttcctattttattcatattaacttcttttgtttctccactgcatttattaaaatctaactaatttatgtgttcacctttttctcatcagcctcttcactagaaaataagttctgtgatagtagaacttgcttgttgtggatctccagcccaatgcttagcataattataaaagctcaatgaatacttatggaaataacacttttaaaaataaatgtaaatagtatatgtttttcttaactcttaagttgcttaaatgtctaaaacgtataagcaaacccacccatgaaacacaagaccatgcaatttagttctagattaattctcaatcagcgatcttctttcttgagatttcctctgcttaagcagtagcatataaaaaatggtattaatctaatgaagactttttttttttttttttttttttgagacggagtctccctctgtcgcccaggctggagtgcagtggcgcgatctcggctcactgcaagctccacctcccggcttcacgccattctcctgcctcagcctctggagtaggtgggactacaggcgcccgccaccacacccggctaatttttttcgtattttttagtagagatgggggtttcaccgtgttagccaggatggtctcgatctcctgacctcatgatccgccctcctcggcctcccaaagtgctgggattacaggtataagccaccatgcccggcctaatgaagactttttaaagttgaagtttccagttcacttagtagtactgagggttaaaggtgttaaatattaatgtttccaacaggattggaacacagcttagggaagtcaagtaaatttgcttatccagtgaggtcgcctgtcttcatgttgcattcactcttctaagaaggatttcatccctttttttttttttttttttttttgcatgagaattgaagcagaagcttgtgctgtattgaaagtatattgaatatgggctccgtttattgatgaagctttcaagcactcaccagttaggaggcatagaggaaagagaatgaatgttcactattatataagttatgggcatggtaggtgacttcacaggagttatcacattttgtcttttgaagttaccagggatcttaaatatgtgatgtatgaaatcgccataacctgagtgacctaatctttggtttggggaaaactgctcctgtcttcattttagtatccttgggaataccagatttggggagctacctagtatgtattcaagaaagctgtccatatttagagtgcgcacgagtgagactgccattcgtggaagagaaagacatagagcttcagggcacagaaagttagtcttttaaaaaagcctcttaagggaatttttttccactatatatgtgaagaaataaggctgatgaaagtaaaagtaatatgcccaactgataaatagtaaagatgaataataatccagatcaaaatgtctctaaagcttgaactattcccataatccttccctaggagcataatataaaatggtgtgttttctccaaatatgatgatatcctactttgtgctgggctccaagcacactgggccagggccataactacactcaactaggccctcagctgtagaaggtatatcatgggtaggctggccagatttagtcaataaaaatgcaggacacccacataaatttaaatttcagagatgtaacaaatacttttttaggctagatatgttttgtgtattgcatgaggtgtatctataaacatcgtatttgttgtttacttgtaaagccatttttgagtattttatctggcaacccctgctgtagggccatgagcacagtaaggagtggctccccagtgacccacttctatctcacactccagttcccaggaaggctgaattagagttaatatgagcagtgcaggaagataagcagaattaatgaggaaacttagcaaaaggggttggaataagagtgtgctttgtgtcccaagggacagctctgcttgttacacgatgagaattatgcacaaaatactaaactgttcccaaattacctcagcaactatggttgtttaacaaggcaaacacaacctgcaagctcattggttctgggcaggatggatcctgctgtcagagcaactgatgaactattttaaagccaagttcctattgtgagtgaaatagattaacacttcagatatggatgcttcaaaaaacaaatagcagcatgctaacttagttaatgagtttttgaggaagaaagtagcatttaacttaccaaaagatgcagttcaaggctatattaatgaagtaataacagctgtgtctttatctgttcactacccattcattttctcattacattcagactgctaacttcagtcacaaacatgcttgtatgagaatatggggccttttgttcctaccagaaaataatcaagatgtctatcttctagagttgtactgtatcatagaagtgattcaatgattctgcttttctatttctgtgagaaaaaggcatgctatgggattcaagcactgtaataaacacacacacacactgaagccaggtggacatttatcaaattttgacttcatctcctatatgctgtgagacatgggctatctgcctagctatatatctatgtatttatgtatgtgtgtatgtatctatctatatcaatgtccaccgctgatggttcattaatataaagattgatgatgtaacaccccacatatgcatttcttgacatacaggcattcaaactatgtttttcctttcttcatttcctaatgtgctacactgtgttttcctggtttactgagtatgcctgtgtgtccagaaaccctcaaggacagagctgtgtgctttaggagtcttcctcgtttttgcccctggaacagtgccaaatactatagaattttagttgcatcttgccacaccacctggctaacctcatctcatctactcatgcctttctcaaccattcagaagcacgttctcttcttttaacacgccgtgattgtccatgcccgtcttttctgcatgtgatttctatgtgccatgacacttaagacttaccaccctttcctaatacatcgttcatgcagatctgcattcttagtgtataaggcgcttatgtgttctactgtaactttgctagattatggtgtcaccatggtttatgtctgtcttaccccaaaatattgtgaaagacacaaacgacattatctcattccagtctcagctggaatttcaaatcccattgtctaaatcaaatccaggtgaagatgaggctcttcacatgtagttccttaagctttggcaacatgagtagagttttcttgacggtagatgtgttaactaaagagacaattatctgtcccacatacacctaacatgcaatggcagacaagcaaacaacattatagacatttctgctcaaaaaggatggtggagggaatggaaggcactgtccagtggaagaatcgctggtccatagcaataatgtcaccaaataaggcaaatgttgtaagttccttgtttaggtctcaaaagtgatatcacaccacttttgccatatcttatttgtcaggagttagtgggtcaatctcacattataaggagatggggtccttgagggcatcttagagattgtctaccacacagtttcccagagcctttggctagtttgtgtaggacttccatatgccacaaaggcctgtgtcacacattcttttgtgttatcttctcaatactgcctgtttaaggtgggtaacagttactaccaacaactaggaccccaggaaaagctcaggtttaaatacctgacaaaccaatgattacattagctgccagtggatacctctgtgtgggtgattaagactattattcacctgtaaaatattcatacctctctcacaggaatgtggttagcataaaacaaaataatctatttggaagaaaacaagcataccctttctctaaaaatatttacttttataagtttatgatgctctcaatgtgtagaagacatcgtttcaaatgtagttacataatatgttgatgtatgcggaatgtgctatataagaaggcatgcctttttttcttggaaaattatattgtcataaaaagtcatgtttttgttattaaaatcaaacactatgtatttacaggtctttttttgcaacaattgcccaatcaaattcttatttctgtgaataaatgatatattattattaattatacatttagaagaagcctcggagatcagcaagttgaacctgtcccttttagctgatcagtctgtatatagagttgaaatctgtctgtctgtatagcacaatgtcatgaagtcatagattcctggaatttaatctttgctcttttaattactagaatttgggtacattaattttcctgagtctcagtattcttgtctgtaagacagggctaataatagtacagtgtatattctaacaactcttgtaattgttgaaaagaatttccctagtcaacttatatttgttctctaatctgctccttcacctcatagtctctctagtccttcaagataattatcttggcttctctctaagtcttatctccttagtcatacttattatgatattattttcaactctttcttttcctgtgcactattttcagaaaagcttcggtttgtcattaactcttcagaagttaaaacctatgtcccatggtattttgaaacttagttgagagaatgcatgtcatacttccagagtagctcatatgcagtaaatgatccaaagtatcctgattcatcttttctgtcattttttttcacaccagagttgtgtctctctccaggagatagctttgtaaatattttgctatagtttttttttttttcctcttccccagccacactttacagagtggagatgatactatgcaattctgtctatttaaaatgtatttatattaagttttcttggtatggaaatattgcttatatttatcttgtaatttgttttggctttatagttgtataagagatataagcaaaatgggtctacactttgttttacctgtctaccattaaaaatttcccttggggggaaaaaaaagatgtttgtcttacataactgcagttgttttatatagcctttagtcaacaaaaatatcactcttagtggactaggctagaactgtcttttagcaacttctacttatatatttatgatgatttacttaattgagatataacactttacatattgttctaactttcgtcatctttgttttttctgttccacagataaaaaatacagatatttttgcatattgaggaaataaagtttaaaaatttgacattccttgagccaaaagaaatgtggaaaatatttttcacctttctgttttgcctgattaatgtttaaattctcatcaaaactaaagtaatttttaaaatgccattgttggtaagatctcacagtttggcaatgcccacagttatgacaaacacagaaaactggtatttctgtaaaattgacgctatactattaaaacaatgtgacattatcccctgtccttctttaaccagtagcatacttgtgttttctacttctaactgatcattattttcccatcatatatttaccaaattttacctagagttgtagaaccaaatggttcttactcttcatactgcaaagacatgaatgatgtttggtaaccaaagaaaaatatatgttgcactaaggattagtgttcttgctgttgccactggtctgaccaatgaaaagatggtaatgtgtatattaaagttcttttctctcatatatacaaaaaatattgattctgtcttataacaactggaacttttccagtcattctgtccttcagatatacacactgacaagtgaggacatactgagatgggcgtggatgtcccttatttattgtttgctgtagaaatggaatcacaatctcagaactacagttccagatttcaaaaccttctttttttggcttgatgttataataggaaaatatcttcaatttggtaaagtcaatcttctatccaagaagaataatcttctgcccgtaactacaacttttctaaatactctttcttttttggaaaatgtatggttatgtatatattttactacagagaacacaatgagttttctaacacaattgtgacaatagaaggcaaaagcatgatgctcctgtagctgaaacaggagcattatctttgggaaagctggagttttctctgaagactacagtgtgcctgctgggtcacagtgattccatggtccggggagattgccttattatgcccaacatcttaggaggctgacatttctgtcaagttgccattgtggaaacagcaataggatatgaatactattatttattaactataacaagttgcaatttctgccagtttataaagctacttgagtttgtaaagcttctggttatgtaaaagtgagactgaagtaattaagaccaaatataaattttgtcctatgtcaatacagatcttcaaaaaaataaaatacaaaatatacattgtaagccaactgcaatgtaatcactgtggctttcagggtttgaggtattgaagaattgtaggccatctttgggggaaagtttaccggatatcatttggaaatgaatccccttttgagacggggtttcaccgtgttgcccagtctggttgcgaactcctgagctcaggcaatccgcctgcctcatcctcccaaagtgctgggattacaggcgtgagccaccgcgcctggcctatttttttttttgtattattatttttttagacggagtctcactctattgcccaggctggagtgcaagggtccgatctcggctcactgcaatctccgcctcccgggcccaagggattatcctgccttagcctcccgagtagctgggactacatgcatgcgccaccacccccagctaatttttttagtagagacagagttttgccacgttggccaggctggtctcgaggtcctgacctctggtgatccacccacctcagcctccctaagtgttgggatttccggcgtgagccacagggcccggccttatcaaagatttttcacgaaataaagataatttcatttccttggtttcaacagtgtttcatggaagagtgtattattttcttctcctattatgtgtcttcttttcatatgccctcaatttcccttactcatttatcttttacaaaggcacttcctttctttatttggagctcaaccctcactagcagtacctcgcatatacatgagtttgaatgttcccttacaggaagaggaatgtatttttggcaattctgagcctttttataaagttcagattggatcgatacgttttgcagctttttttgactaaatgaaaactactttaaatgcattattttacctatccgactgactttgtgaattaatggaataatacgagcaatacacttgggctttggagcttagtattgtcagtgctatcgatttgtttagaatatttccatgaatagtttataggatcctagcacactgtggctgaacggaccttttgagacctttcagtctgtaatccagattcttatacttactgagaactgaggctgagatgctacaagacatgcctacattttctcaagtaaagacaaagttaggtttcaacagcaagcatttcttagctatctgctactaggcatagtcttatcatttcacctttactgcttttgtctttaaatgacaaccagttcagatcctcaattcttatagcccaatgtatttatacctagatagaaagatagatagttgtagtccttcttcaatgaggattccatacaattagccttgaggcttaatgacacccttgtaaaatcgttctaattagcaaagatgcattatcacagaagcagttcttacccttcggaaatgtctcgggaaatgtctcacgcagtcattattttgatctggctaaagatgcagtgtagcaagagtggctaggttctactcctagacgctgtcatggccttgttattttcaaagggtgtttgtaagctcctactaccgtgctgcattcatctgtgtgtccctcatgcccagctcagagattaggatagagcaagctcttaaatgttgctggacaattggattttcataagtcacttttaatgattttacatacccaagcatcagctccgattacgctgaaagtgtgatgctcctcttacctagatgacatttaaactcccttcatattgaaaaacagaattatctaaacaaaaaatatggttgaaagagtttatggcaaatagaatttggctgtgaattatgttttccaatccctgctgtatagagcaaattgttagaatcagcatttataattgagtttcaactaaatgctttgttttataatttgctgtgaggtaattagaaaaatgtgcatgaaagcatgacacgtataaatcacaggtatattcatctgaagtattttgtgcagtttatatttatagctcattctgtgaagctaaatccactgtattgaaacagacaattaaaggaaggtaaagggactattttcccagcaattgcaatgtgctaggcatgatgccaggcactgcacaagctctatctccattaatcttctctaatgtaaatattgccaccacttcacaaataaagaaactgaactatgtataaaactgagcttaaggggattaatgaatatattatttgttgttgaacatatgcaggtctaattaaagtaattgcaagttatattaaaagaatttgtggtagagacagaagttgaacccagtgctgactggcactctagttattgttataaaggcaatttgtattattgagttactttgaataatacacattttacatttatttaaataaccatttaatttgtaatgataagtttacagattttttaaaaatagaaacatattatggcatcattgtgtatcaaacaagggctatttataagagctcccttggtgtgcttttattttccttgtctaaatggagccagatgactagaaattgtggaaaagcatagactggttcaataaaatcgaacctggagacaaatccaattctatactctaacacagccatttgtaaagtgtgttccctagtgatattaagaggtgttttgtacacacacactcacatagcaaacattaaaaataaataaatggttacatatgtgcatgacagaattccatgatcaaatatgttgagggattcctgggttgaagaaaataaagcatttgttttaaaattgtgtaaatgctcatatccattgacttgaaaatgtgcctcgtgaagctccaagggagaaatggaatttaaaaaatccccagaccttctcatcacaaaaatctcttttacaagaaacaattgttaaatcttggagtgtaagtagatagcatgatacatcttgggaaatgcttattcatttacttattaacaaaagcgtatgagcacttactgtacgccaatcattttataggtattgggaatgcagaatgattaaaactgacaaagatttctgcccttgtggagctaatattctagcaggggagactaaatataaacaagacaaagaagtgaaatatgtatgactgattctgatgattcttaagaaagaaaaaataaaaacaagcagataaaaggctggacagtgtcaggacaaggagttgaatttttaaacagggagccagggaaggcctcactaagaacgtagtattttagtggaaattgaagttaaggaacaagctctgtggatttttaagggaaaactttccaggcataggaaagttgaaattcaagcgcaaggcaactgtgactggagcggaatgagcaaggggaggagttagatgaggtcagaaaggttaccaggacccagatcgggaaggtccttgaaggttatagtaaggaatttggttttgagtgaagtggggagcccttggagggctttgaacacaggaatgacaaaactcggtattagagctgattttttgagaaaagccaggtgtggttgagagggagggtaaaacaatcaggtagaaggctactgtaaggatctagaggagacacgagggtgacctgaacaaagatttcagccctggtgaactccaatcggattctgaatctatactgagagagagtctgctggatttgttgaaagagcggataccgggtttgagagacagcaatcagagatgagccaggatttcgacttcagtaactgaaaagatgttttgaacttcttagaatgaggaagaccttgagagaaggaggtttggagagggaaagttgaatataaggagctaatttttaggcataataatatcaagatgcattttatgtattcaggtgcagaggtggatttggcagatggaatactaaagtaggcggtaaatatcactcagtttacatagatagatcacatggaaattccaaagttagaatggtctagatttaaatagctaattctcatttacagaaacttcaacgtgaaactacaattctataagctaacttgtgcagccctgcttccagaagaaacaaagaaacagaaaaaatcaaaagggaggaaatatcgcctgccccagtcttaagtgattcccattcgttgcctttcctgggcttgaaggtggagttttgagtaaaacagcagcagtggttgctggatgctttctgatggctctacagttgccctgaaggaatctcaataggagtgttccttaagaatcctgctgatgagcagcactccaccctcaccatcttcaactgaaacagccttagaggaatttttgctggtttatagatcttctgttttgacaaagatagctcgtgacatcactctgccaggctgaaggacttctattctgagactggtgacagcaagccaagaaagccaatactctaagtgaatttaatagactctattctcatgctacttgggttgctatgggaaccttattagaaaatacagggactctagatgatctgctaagttttttttttttttttttaagtaatgtaagtggctttatcttcaggaaaaaaaataagttgtttttctaaaattgtgaacatatagagaaaaatataaaaaacctaaatatgttgcttacacatttgttataaaggacaaatccgtgtaaccagacatatcaaggaaaagaacggtgctgattttttaaaagacagtcacttgcccctttctactcacagtacttccgttatctcaaaaccataaccaaaacaaaaaacaacaaatatcttattatggtctttattttcatgcttgtatttagcattgtatcacccgaacaaaactgacttagactgatttattgcatattatatatacatacataatatacattcatcatgtgaatataatttatacattctactgttcatgagcctttggttgtttctagttttaggatattaggaataattctacctttctacattttagtagccatctttgtataaatgtgctcatttctatttagcatcgttggaccataagatatatgtctcttcaaatttaataggtactgccagacacttttgtgttgtggttttgttgttttgtcctttggttttccaacattgttaaaccgatttacatttcaacttgaattgcgtaagacgttctgttactccacattcttttctgcaccttaaatggtccctagtttgtatattttgccattctattttgtgtgtagtgatatcttatttgtctcccctaaatgagaatttggacaattttcgtctttatttgacatttggataatctgtttgtgaagtatctgttaggtttcttattttctgatagatttcttattttcttattgatttcttagagtaattacttatataacatacaacttgtagctttacaataagtttgtatttctggtagatcaagtaaaccaacattatactttttctacaagtgtgtcctagttattcttggcaatttgtatttctgtataattttaaaatcaactctagttatttttaaaaagaaagaaaaaaatgaacttgatttttatgaagattatgttaaatctatagatgagtttgaaaagtattgataaatatttacatattaaatattctaatcggtctgcttaaaatacatattctttctgtgcatggacattgtctacctcttctgtttgggtcctctttaatgttttccaatacaaatttatagtttgaaaaataagaatgaaaataaaataaaaaatgaaatattctaatctatgcttgtgatacagatttctttatatcttctttcatttgtttgtatcttctttcatttccctcaacatattttatagatttctgtctagaggtctcacacatccttgttagatttaccctttgacatttagtttttttgatgttattgtagatgatatgaatttttaaatttcattttatgctcattatcgttacagagaaattcagttggtttttatatattgagtttatagctagcaaccttgttactcttacttattacacataataattcatctgaagatatttttggattgtctataaaatcatgtcatctgaacattaagatttttttgttctctcttaaatttaaatattttattttttcttaatgtctctctgtctgggtagaccatcttttacaatattaattaaaagtagtcatagcaggtttaattttcttattcccaatctcagaatgaaagcttttaacaatttaccttgaattatgattttgcttaaggcttagaagctatctgctattgcagtaagaaagtttcccttctatttctagttatcaaaaaaattttaaaaattataaatatatattgttttactcaatctatttgtatcatatgatttatcctttagtttgttattgtaatagtaaaattgattagttttcaagtgttaaaccaattatgcattcctgtaataaattcaacttggttgggatatattataccttttaaatattgctagatataagagttctatttttgaaagattttttaaattcacgtttataattgtaatttgggccttattttaccatgaggaaatagagatgttgagtactagtagacatttttaggcctaaagatgaaaagtcttcagtgtagccaaaaaaaaaggcaagcgagaaatgaaagaggcaagaggaaacaacagacagggcacaagagattcaaagagaaaacacataaaaggatgttagaaataggccaagcatggtggctcacgcctgtaatcccaacactttgggagaccaaggtgggaggatcgcttgaagcccaggagttcaagaccagcctgagaaatatagcaagacactatctctacaaaaaattttaaaaattagccatgagtggtggcacaggcctgtggtactagatactcaggaggctgaggtggaaagattgcttgaacctaggagattgaggctgcagtgacctgtgatcataccactgcatttcagcttggatgatagagtgataacctgtctcaataaataaataaataaataaataaataaataaataaataaaagttaaaaataaatttaaaaaataaatcttcataatcaatggacatatgcacatacataccaggcaaacaataaccagagtaatgtgtattattaatatcacataatataaaattaaggaaagtttattagaaataagtttctctctagttaataaaatgtttacctaactaggaagataaaaaattgtgaaggtatatgtacctcataacaccacctcaaaatatataaaggtaaaaatatgtgtgtgtatattcctgtaactatgaaattgatagaataaaaaacaaacttaaatatttataacataatgggatatcttaggcacctttcatagtgattgatagatcaaataaataatcaaaaatttaaaagattatgtatgatatgaagtgtataattaagcttgatgtgatggtcacataatgaatgttatatctgaagaacagatactgtttccaggaacatatcatttatacaaataacaacattctagtgcataacacagcctccacaaatttcaaagagttgatattttgcacaaaatactaaccacagtggaataaagttaaaaattaataacaaaaaggaagaccagttatgccttttataatcagggatattaacatatttatagttaattcttagaactagaagtaatgataatggaaattaggatatatttagaattaatagaagtgggccaggcgcggtggctcacgcctgtaatcccagcactttgggaagctaaggcgggcagatcacgaggtcaggagatcgagaccaccctggccaacatggtgaaaccccgtctctactaaaactacaaaaatttgctgggtgtgttggcgtgtgcctgtaatcccagttactctcgaggctgaggcaagagaatcatttgaaccagggagtaggaggttgcagtgaactaagatcgtgccactgcactccagcctggcaacagagcgagactttgtcaaaaaaaaaagaataaatagaggtgaaaatacaaatacttcatattgaaatgtctaggatgaagctaatgccatgtttacaggtaaatttatgaacttttcttatattagaaaagacaaatggctcagtgtaataaaccaaaaattccaccaaaaaagttagaaaaaatgaatcatagtaaaccaaaaagacagaagtaactgataaagaatagaaggaaaaaatgaaataaaaattatcagataaagagaggatcagatgagacaaaagttggttattaaaatgttaccctataacaaaacaaaacaaacatcaagctcagttgattttggagatgagttctataaaacgtaccagcaacacaatttcaagttatacaatctctttcagagaattgcaaagaggaaacatcccaaaatttattttaaatgcatggcataaccttaaagacaaaatctgtcaaaaacagtacaagtgaggaaagagcaaattgaacccagcaaagtataaggagataatatcacttgatcattattcctgtaatgtaatatttcttccattttagcaaatgtactaggtgtaaatcaccacattaaataataaaggagaaaaaaatgatcattttgatagtaacaaaaaataattaaataagcctagcatatattttttttagatgaggaaaaactgttaggcaaagttttacacaattccttttaaatcagtggggaccaatagttttaaaagggtaagatttaagctgctctacaaatctacatataaaccaatttgtgtcaacatctcccattttctttgtcatccgtaataccaattttggttctcaggttaatatgtcatttttcctgtttgagatttttctcctgtacttagagtcctttaacttctccactgcctctcacatctttttgtataaatttgtatttttcctattaagactcaattcatctattaccttcactgagaaatattcccgagaacccttaccctgaattggcacaactatcaggctccataagttttgcctctacaataattttttttttaactttaagttctagggtgaatgtgcagaatgtgcaggtttgttaaataggtacacatgtgccatggtggtttgctgcacccatcaacccgtcatctaggttttaagccctgcatgcattaggtgtttgtgctaatgctctccctccccttgcccccactgcccgacaggccctggtgtgtgatgttcccctctctgtgtccatgcgttctttgttcaactcccacttatgagtcagaacatgcagtgtttggttttctgttcttgtgttactttgctgagaatgatggtgtctagcttcatccgtgtgcctgcaaaggacatgaactcattcttttttatggctgcatagtattccacggtgtatatgtgccacattttctttatccagtctatcattgatgggactagttttatgattcatttctatcatggcaatttctatatgatattgctgttaatatgtagatgctattcccactgagctgtgaactactcaaggcagggggtgtgtcactcatttcagacctccagcccttagcactgttccccacatcctgagggcatccaatacacctttgtcaaatgggttgaagagttgagcttagaaatttacattctttgttcctgggaaggctaatcatagagaaggcataaacatgaaacattaaacaagagagtttaatcatattttaagattatctgagaaaaaaatgaaagacaatccagcacaataacattctttttttttttttttttgagacagagtctcgtctcgctctgtcacccaggctggagtgcagtggcacgatctcggctcactgcaagctctgcctcccaggttcacgccattctcctgcctcagcctcccgagcagctgggactgcaggcacctgcctccatgcccagctaattttttgtaattttaatagagacggtgtttcaccgtgttagccaggatggtctcgatctcctcacctcgtgatccgcccgccttggcctcccaaaagtgctgggattacagacgtgagccaccgcgccctaccaataacattttatttctcattttaatgttgtaaaataaagtgagtgacagctggtttgagtcaccagtctgctgtttactggctggcctaatgtcatttccttgttggtaaattatagataattattttactatagcattaggttgttgataggatcgaatgaaatactgcagctaatgtactcaatgcagtggctgagacatggaagtgcctctgtggtctatgagtattatctttccaatcttgagaggtagtagaaggctacaaagtgttggcgtttgagtggtgtttaagaaatggagacaatttgaagagaaagtgatttgggggtttgcaagtacagtttacatgatgaaaggtaagaaaagaatgaggctgacatttattgagcctcttcaacatgtgagttgtttgaccaggcatcttcctgacatcctaccagttaatgctcacaaccagcacctgatgaggtcctaccacaccatttactcatgaaaaactgctctctggaagttatgaagcacatgctgaagatcacacttggtggaaccaggctccaagcctgtctgattttatagctactgaacttcttctggagatggctagaaaaggaggaatcaaggatctgtagaatctttcctgtgcctggcaaagaaggatgaggctgactgtgaatgaatttgtggatatagataaatagctattttccatgaaatacctgtttattgttgtaggacatctaaaagcagattttaatgagaagaatgatgttttgattttctacatgaaaataaatgtgaacattgatatatgtaaaatatgtaagtgaaaacctttgctttttgaaaaattaaagtcagtacctcaaatgtggcttataagtcagcaaaacaacctgaaactagatttaatatcatgtttattcaacaaattatatggttagtaatcagtatgaaaggttgtttcttcccagtggactgtagcagaaactaacctcattacatttgagaaaccatcattgctagggactagttgaaatgtctgtctcagaatggcaaatggaattgcattttaaagaaacttagagtctttattgttttcatcactaaaccccatactcatgattagcaggagtcatttgtcagctgaaatcatactggttcttccattttagtttgatccatttccatccatctgctcatgagagaagaaattcggtttggtgaaggatgtctggaaaatgcgaagaccaccaacttgggaaacttttatcatcacgatacactgtgtatgtctctgaacaacaacatggtttgaatgaagcaaaatagagacttaaaatgtaactaaatgtacaattgtatgaatgtgtaagtgctatggaagaagaagcctttagaagttctcaatatttactgcagaatttcaaaatagtcttggattaaacaccttttgagaaaaaaatagacgttcctaaaccataatctaatgcttgagagaacagaataattttcagtacaagtaagtttaaatgctaaatgagatgagatggttaaatgtccagatgaaaggtaaaatacattgttccatcactgaattcacagtaacatgcaaaagatccatcttgaatataacctgcccagtccctgaaacaaacccaaggcttctttttttttctgatcttgatttcttgaatgcatagtgcttttaaagaactaacatgtcttttttgttttgttttgttttgcgatgcagtctctttctgtcacccaggctgaagtgcagtggtgggattttggctcactgcaacctctgcctcccgggttcaagtgattctcctgcctcagcctcccgagtagctgggattatagatgtgcgccacaatgcccagctaattgttgtattttttagtagagacagggtttcaccatgttggccagactggtctcgaactccagacctcaggtgatccacccgcctcagcctcccaaagtgccgggattacaggcataagccactgcgccctgctagaactagcatgtcttaatgtgttaggtaataatagaaatgtttcattctctaattaaatgatgaggtgattaatagtaggttaaagatactgtaattatatattgagtaggatactattaatatatgttcacttagcacttactataaggaggaagacataatgtagccttacagcccagcaactagggacccttccaacttcaggtcctcaatcttgtgcagcagacctgcagagtctccttaaagggaggccagatgtgccagagagtcagtgcccctagagcaaccctcaaccaatgagagatagcagttgataggtaagttccacagcctcttgctccacattgggacaaccctgagtctgtccacactggggctgagccctggttgcctacagtggtcagccacttattaatccatcctttattggtctctcccttttttaactcccaaaccccctcacagtgttccttgggatcaattcctaaatccttctctcagagtccaactaaaacgtggaggcaaatatgtaccaaatagagctcatgttctcccttcaagaccacccttcaggtgtcaggagcctcacctggaggctccctacccagatggtcttaaggtgctcacagggccagctcagatcaccctttccatgggttctgactacacaaaagtagatggtgtgccacagtccatacccctaggcccaaaatttggaatgaccttggacatccagattgattgcatacacatttgcatgatgctcttgtcaagaggaaatcagagtgagaagggaaagggagcaggttctgggcctgggcctccatttgcattcttgccttggaattctgagacattaggtgtggggctgaatagaaggccaggagttttaccttttttttttttttttttttttttgagacagagtctcgctctgtctcccaggctggagtgcagttgtgcgatcttggctcactgcagcctctgcctctcgggttcacgccatttttctgcctcagcctccctagtagttgggactgcaggcaccccggctaatttttttgtatttttagtagagacaaagtttcaccatgttagccagagggtctcaatctcctgacctcgtgatctgcctgcctcggcctcccaaagtgctgggattacaggcttgagccaccgcatctggccaggagtttttatttcattggttacacgcagtgaattattggcaggtgaccaaattgttttggtctttaacgacttcatgtgtataatgagggatgtatctaaatttattcatagggtccctacaagaccataggttctcattgtcaaagtcatagatagccattcttctgcacataagggacactaaaaagtacccccttattttctggctgggatctctgaatgctcacactgtatgatttggtggggctctcatgccatctgttctaggcctctatttactcttggtttaaagaacctagagtccaaaggtgcatgaataatgcaagtcatattttagataaaataatacagataacaactgtacttaacagtatgaacaaaatcatgcaaacaaaaccaaaattgatatctgaccagggagaaaggacttaggaaatatatcagtacataaatagtgaatttttatttggatgtgttgcaggaatgtgcgtagtatttttttctctgtgttttaactttttcctacctgtgcatttcttagaatcagtagctttgtcagcatgcactcagagaaaccatggaagcatatttagtaataaaattgttattcttatagacaaatataatcgtttaggaactagcatggcccttttattctcaaaactagcctcagtcattgacgatgattgctatttaaaggtgtagagggaaatatttggggaattgtctgcgtatttcaaagtacccttaaaaatttaaatcagacaaactggataaattagacatcctcaagtactaataggcaggtctgctctaagaatagtagaaggtagaagaaattaatggttacgagaggggtagaggaaattaaagttaataactaaagatattgcactagtttgtttttgcattgctataaagaaacacctgagacttcgtaatttataaagaaaagaggtttaattagctcaccgttctgcaggctgaacaggaaatgtagtgacatctgcttctggggaggccccaagaagcttctaattatggcagaaggcaaaggggcagcaggcatctcatatgatgggagcaggagcaagagagagtggtgtcacacttttaaaagagatctcatgagaagtcacacagtatagcgaggacatcactgagggaatggtgctaaacaattcatgagggatcccctgccatggtccaatcacctcccaccaagccccaccttcaaaattggggattacatttcaacatgagatttgggtggggacacgcatccaatctggattgcatatcctcatcaaaatgtcaatacttttattttgatagtgttactatcattaactatgtacagtactttattgttaacaatttttttctccagcataatactgtttagtatgacattactgtaaattattataaatgtcttaaagattattaatttcagaatgtatgatgtattgcctttaaaaatgaacatggactttttaaactaatataggtataggaagaaataaaatctcattccttgacaaatactaataaaacttattattgagaataaaataaacagtacttatattatgtcagatattctgctaagtcttttgcatgcgttatttcattttttaaaatcacagtggccttatagggttggtataatgatccccattttacaaatgaagaaaatgagacccagacacactatacaatttccccagattcagtcagaaaataaatggtagagctgaaaatgtactcacatcctaaaggctaaagcctttattatgataaaactctgtgagatgacacacattttgatgactgcattagtttaaaggaaatttttttcatggattttgccttcgttttgctttgttttgctagtgaaattggtcctgctaagcagtataacacaaaatgagacctcagatctaaaattcagagagctctaaaatcaccaaactaatctaataaaagaaaatacagattttaccgaaatttaataggagttagttaatataaatgtttgaaataataaacatccccagaactatctaacagcatgtgttataatgtccgtttgaactgattttaaatgaatagaatgtttttcattccctcctgtactgagagcgcttgcctttgagtgttttaatatgtcagggatcatttatattctcaaaaatatattacatttatttggtttcattctttatctttcaaccgtgttttaaatatttacaatttcagcaaatttgaattttttttgtctttaaaatgcctctccaaaggttttgaaatctctatgtgtttgtgtgtgtgtatgtatggcttttattggccactgatccaagtcgctccaaccttagagaggtggaaaaatggtgagaatatggattatgaagggacaaaaggatggaagccaaaaaaaatacaattcataaaaggtcctggaatctttcctacacaaatgcccagaggcctcctcattctcaggtactgctctctgcaggatgaacctttcacctccactcccatccagctctaggagtgatcctccagaagaataatgggacttttagtgattccctgtagccaatagccaagcggcagcagaatggtacatacagaacaggtgaagatttcttaagcaccagcagtgattagaacacagtgggataaggtcaaacagagcagcagatggctaaaattatatgtgaaagtcgttttataattgtgaagaacttggtggtggtgcacaaatccacattctgtgttattcaggtacctaacatcaatcctcctggtttggaagacttcagatttcacagtttagtaatcaccatgctttagcaatggtacttgcttttatttagcggcactgtaataaagattactcttaatttaaagtataccccttatatagtagctttttcgtttcattttaggttttaatatatttgttactgtagctaaatacataaatggataggtaaatatatagctagatggatataaccaaccgaaagatacatgagaccatttttagtaacattattctattattgcatatatttcatatactatgtacatcatggacaaccttgatgatgagactcaggcaatctgattaaatattgggtttattcacagtttgtaaatattgggtttattcaaagtttgtgaactcaggaggacacagactccaaaaggaaagggtcagtgctccaaagagggaatgtttgaagatcatttaagcaggaaagttctggggaagattaaaaagattacattatttttccatagagggttagtgaatagttacaacaatttgcttagttatatgcagcatttctttttttttgaaaggcatatttaacattctatattaaagaaagacgtaatagtcaaggggtcttttgtctcagtcaaggggtctttttttatgtcagggccacgtggtcttagccataaaaaaggaaattcggaaggaagttaatctatttttgaaaggtcagtaattaaaagttcaagctgtgtgactcagtttccaaagtcaacaatcttcagggcctaataacttttagaaactccaaatagacacactatccatttgctttcacatcatcaattatgtatttaaaaagaactttgtttctgtatacattattatatgtattatatatgtgtatatacatatctgtatacacatgtatagttgacccttgaacaacatgggtttgaactgtctcggtccatttacatgcagttttttacaataaatgtattggaaaattttttggagatctttgagtttttgggtttgaactgcattgatccatttatatgcaattttttataatatattggaaaatattttttggagatctatgagtctttaaaaattcacaggtgaactgtgtagcctagaaatatcaaaaaattaaggaaaagttaggcatgtcatgaatacataaaatctgtgtagatactagcctatttcatcattaactaccataaaatatgcacaaatttactataaaaagttaaaagttgttaaaacttacacaaacacagaccataggtggcatcatttgcagtcaagagacacataaacaaatgtaaagatgtagtattatgtcttcactgcataccattcactatagcacatactgtaaaactgtaataagtttgtagttgcttcttgttgctatcgtggtgagcccaaatgttgagcgtgtttgcttaaaatacgtgtgatactaatcatctccatgtaagcattttgcctctccagtaaattgtatatccagtaaaaagtgatctctctctcttgctgttcttatatatttttcattgtgtttagtgcagtaccttaaaccttgcataacaccatgggacccatacaaagttctgctagtgatgctggaagtgctcccaagaagcagagaaaagtcctgacattataagaaaaagttaaattgcttgatatataccgtggattgaggcctgcagctgcgggtgcctgccatttcagacacaattcatcttgtaaacagatgacataaacttatggtattgataaataaagcacagtacttcaaatgtattttctcttccttatgacttccttaagaacatttgcttttctctagcttatcttattgtaataatacaatatctgatacatataccaaatatgtgttaatctactatttatgttatcttaaggcttctggtcaacattaggctattagtaattaaatttgatgggagttaaaagttatacctgaattttcaactgtacaggggtcagattccctataacttccacattgtccaaggctcgactgtacattacatatatatatatatgttataaagaccagcaagatttcagacacaagcagtgaagtctggacttacagatgtgttgactctggttactgtacatgtcttgtcatccctttggcattcaatcgtgtcactttacattatcagcttgtattttaacatcttctttttttcaacaaatatgcagaatagattttctaaaagttcagacatggtacaagacaagcttgtccaacccatgtcccacaggccacatgtggcccaggacagctttgaatgcagcccaacacaaattcataaactttcttaaaacatcatgagtctttttgtgattttttttagctcaacagctattgttagttttagtgtattttatgtgtattgcaagacaactctttttcttcaaatgtggcccagggaagccaaaagactggacacccctggtgtaagagatggtggcatggtaatcacagtgcctctttaatgtgtcatggatactcattaatcattcaacaacagaaaatggttggtctcctttgccctccttaaaatgagacatggaggatgagcagcatttaaaccggaagaaagggagcttggtggggaagatatttcaagcaaaatgcatcaaagtgaagttctagaggtagctaagtatggtttatgcacatctttgttgaaacagtattcctcaatgttttttatatcatgggaaacagaaactatggtttgtgagatttgaaggaatacatagaagcatatcttaggcatatgaatgggatatgcctatatcaaagaacagtaatgttctttgctagacctctgtgttagagaatcatatacatgaacaaaaatattaggaaatcaaaaaaagtagatggggaaatgatttcagagggtttcaatggtgataatgatgtcaacaaaaatagcatcgactatttttccctgaggagcccaaagtatttctgatacatacttccagtcatagatggaactgattgagcacaagcttaattctaacagaaacaaaatgtgagaacttgaactttaaaagaacattttctatcctgtagaaagcatgatctaaatttatagtatgcctgacaagtgtggatttttcacaattccctgaaatacagaaaatgaatttaattaattgtgctccaaggctgagttcatactttggcttgaattcattagcaagtagcattttaaaaaggaagtttggttgtgggtgtctgtccaatttggaaatatttacccatggtctttatatttaaaatgtgtttttgattttcaaattctgcagattatttatatccatatgcctgttcagtttggtgtattcataacatggttcacactggccttgtattttctcagttcactgtatttatcagtttctctccgattgtcttaatccatccagtcctccattccatttcctaggcattttctccaaagccttaatttctttgtcttcttcttctgtgttgacagtgattattgaaagctttttcttcattccaccaggttacctgttcagaaattgggcttctaaaataaggcatttagcaccaaaatctctattatttgaatggttattccatgttttcactgttttgttgtttcattgttttttgtttattttgttacatgtttttactgaattattatttttatgaagttcttcgatagtgcaaaaatcttggggaaagtgtgcttccttttctttaaatacactgtctttcagaattggcttttactttccttgctttctgaacctttattttccttcattcctgctaacccccgacctcccatttctttcttcctttctctctagaatttaaatagttatcaagttgcttcttttcatttgctcatatttatttaaagggcagctttgtctgaaacttctactcatctggatgcactgagggattgctctctttgaccctatccaagatattaacaatgtttctgtcttttccctgggcttcatgtggatgctaattttgcttctaaccacattcctgtatcctgagggcaatgggataggttagaggctagcttagctgtggccatgtcatatgtcaatctagcaagactagattatctttaccaaaatcttatcaaaaatatcaaacatggccttctgcacccagctacgtgctatcctgctcatacagcttcacccaatttctaaaactcagcatactgctctagaactttctgactccactgagctcccatagcagtatgttggggcttctcttcttaaaactattccctcaagtagtctcctcagctctaaaaattgagtgggaaaaccagcaagaatcttcagggctttattcccttctgctcctcaatattaaccctgtggagaagacatggggtttgaggcttcacacgtcgtatcataatttatactacttttcatgacagcaatgttaaaataccttgtggcataagatcacactctagtccttttttagttgctgctgttgaactttgggcttttattaaaacattaatttctataggtgttggggaataagatttgtaacctggctttacttaatcatctttatccaaaaaatattttaaaacagcaacagtttgacataaatgtagcctcagaattttcaatattagaagaataaataagttataaattttgcctatttctatattgccagatagaattttaagaccacaagacatcatgaaatttaaattaaaacatgtccagtaggaaaaaaggttttgtcacttaggtaacatgactaacatcctaatatgctttctcgcatttttttaacataaggcaatccattgagcaaatcacaccaacatttttttttcatcattcttaaatgtctctcttctagaaagggtgaagcatataaaatcaccttgttattaaaggagttaagaaagaagtctgcagaaatcagtttggaggaatattgaatctagtgttttgttttttcatagaaactttagaaggcatgatggtgattatacacataaggaaataaagaatggctgtattaggtcttaattagtgattataacagtggcaaaataacagaagttgaatgggtccttacatctcacttcagagaaaagtgtaaactgcagtcaatacaaactgatttgggttagcagtcctattattctcagttgcccagagaatgaagaaaatgttctttatcccatcgctaagagcagctacagtgaggcatcctctcttggggcgctgtctacccttcatgcctctagagattcttggactctttgctgtcttcactgagttttagttcactgggggataaattcttataatttctttccaggtttaaaataatacctgcctatatttatttgacattatacagaaaaattttggaagatcttcttatgtaaaatttatattctgtggagttgaagctatattatgattttataattttctggaatatatcattttaccccacttttaacagtttgcgaatcatggattctattgtagtctcctcctttctcaagtcagttcacatcttgacaaattttttattaatcaggattatacaatgttgatccagtctgtctggaggctattaagaagcattaatggaataaaagggatattaatttatcatcaattatttaaatggactgtttcttaaaccagtctgtgttttaatataacttgggcctatggaaccttcgtagttgctattaaataagaaatatatgtgatgtatgttatacaacatataaggtatatattatctatacacttttcatttatttcaatacagaaggttttccatttaattccacaggtattttttaagcactaactgtatgcataggtactgtatataaatacaatgtaagtagaagctgcagcccatgttttgaggatgtgaagtctacatgtgtagagcaaatgtgtgaaaattatgaaaccatttaaatatatattgatcaaagcatgtaggcaatgttttgcctgtcttgaaagcttagaaccttagcctgacttatgaaacttactagatatttacccgtgggataaaccatcattcctccttgagcctgattaagctctctttatgaagacattatggataaagtgtcaaaatggtgcctggtttggagtagcttctcaatagccattacttttctgcaagcctgatgaagcatctcacatcacaagagactttcagatgtctgtgtattgtggtggaaaaccaactcccattcctttgcaaggccagaagcaaaagctgccatgaggaggtggtcttaacatggcctggcacatgtaagctgttaactcactaggaaggaacaagtttgcaactggtgcaggagaatgtctcagtgatgagcaagacttctgcagtgagtccacaagtatgtctttatgcctggaattcattatcaaggaattcagaaatgttttctgagaagaaatccacctcggtaccctgcatatttcagtacaccttgacctgagcagaagatacactgagacctgccaagttctgagcatgaaaagctttaattcattgtgttaaatggcaaaaccaagcaactggtgatttatggctgcaaattatcatgttgttcattagtggtaattactactcaaccctgaaataaaacggcaatcagtatgctaaaatgagaacacccacgctaactccttgctgttcacctgcaatcctctctgtctgtctcactttccaagggaagagaaaaaagactgagggaatccaggtgcatgtactatggacagagatgagcttctggccatactaaactgcttcagtggctcctgtcaggcaaaggagcttagctccatccctagatgctctctgttcacaatgagataagagatttgtgtttggacatactctgggaatgctcagattgctttcagcgactggagctgtggcagtcaggagggagaggaagccaatggaggtagtgtagtgagtagacaccacgccctcagcgactggagctgtggcagtcaggagggagaggcagccaatggaggtagtgtggtgagtagacaccacgccccagatgactgtagctcccgtggaccccattagcactgtcctccagtagtctcttcaggctatatgcctggctgaccatcaggaaactgaggccatgccttgcgtagaaagacttaatttcacttttgaacagatggccagaaaccatgcaatttcacctgctgtatctgttaatgtcacactaaacagctatgaagtaaaaactcccatgcaaacaggttttcattttatttctgtcacaattattacctcctagagatgaccttcaatgcagagaaatggatttttgactttaacataatgaatcttatgagcagttcacacaggcattctgaagaacaatacaggttgaacatccctaatctgaaaattcaaactccaaaatgctccaaaatctaagattcttgatcattgacatgatgctacaactggaaacttttacacccgacctcatgtgacaggttgcagtcaaaacacaagcacacctctcatagtttattcagtgaccccaaggggaaaaaaaaagaccctccaagtaccattcacttgtgataggtattttctgtgcacacctagatactcccacacaagtatgcccacaatggtaataaaatgacacatgtgcagaccagaagcaccagcagtaggttcctaatgatgttccacatgaggccaagacctacgttcattactcactgaagtttttggcttatgctatgctctgtgatatcaaggatgtgatgatatttgttgaaaatgtcaaaaaagcctgtagatacctctatgagtaacagtgataagaacaagaagaaggatttatgttaatttagaacacagaaagtcaagctgttggagaaactgaacagcagtgtaagtgtgaaccatcttacagaagtgtatgatggtagaatggctaccatatatgacttgaagaaacagaaggataaactgttgaaattctatgctgaaagtgataaacagaagttaatgaaaaatagaaaaacactctaaagcgaaaactgaaggtcttgattgcatattgaaagagtggatccagtagtgtcatggtaaacatatgacaatcatattctggccatgaaacaagaaaataccaattacaatgagctgaaaaattatagagaactgtgaagattcaacacgctggctgcagaaaatttttaaaagacaaatttgtaaagacttgtgataaatcatctgcttatcatgaagcagaagagaaattcattgacaagtttgccaatgtcatcactgctgaaagtctgacaccagaataagtctataatgctgatgtaacataacgattttggtgttattgccccagaaagaaactgactacagctaatgaacagctactagaggaattaagaatgccaaggacagaataactgcaccaggatgtgctaatgcagcaggcacgcttaagtgtaaacttgctgtgttaggcataagcttgagtcctcaatgttttcaaaaggctaagttcttacttgtctattattatgctagcaggaaggcatgaatcaccagagacatcttctctatctggttttacaaacatttgtaccagtggcttatgctcactgcaaagaagctgaactggatgaggactagaagatttttttattccttaacaaccgttctgttcatcctccagctgaaattctaaaaaataatgtttatgtcatgtactttcccccaaatatgacttcattaatttggccatgtgaccagggtatccttagatcaatgatgagtaaatataaaaacactttattgagcagaatgctaacagcagtgaacagtagtctgggtatggaagggtttcaaaaggagtttagcataaagaatgctgtatatgctgttgccaacacttggaacatagtaactgaagacacagttgtgcgtgcatggcacaacatctggcctatggctatgttcagtgactatgtttcaacccttcttgcacagatggactgactttaaaatattgattaatggcagcagaattaaatccctttacaaaaatcattgtcattctttaaatagggtagagggtttaccttctgaattttccatttagcatgggtcagaggtaaatatatatgtatgcacgatctttgcagtgagagaaatcaaagaatattaagatctctttatgcctgctaattttgagttgtgaatttttgagtacgtctaaagaatgggatatggttaagtggtttataagcattttttttcagtccttgattcatcttttcattatctttaagggcagatatttttaatttaaaaaaatctaaaattttaattttttcattcatgggttgtgcctttggcattatatctaaaagctcaacacgaaaccccaggtaacatagattctttctggaaagttacaagctattaatttaattcttttaataaatgtagtcctattcagattatctacttctggtttttgtagattatgtcttttaaggcattgatcaattttatataatttataaaatttgtgggcatacacttgttcataatatttattatattttaatattgatgagatcagtagcaatgatccttctttcattctttatatagtaatttttgtcttctttcatttttttcttagttaaactggcttttagaggtttaacaattctatttatcttttcaaagaatcagtttttcttttcattagttttctttattgatttcctgttttcaatttcattgatattgctctagtttttattatttctcttcttctgattactgtagatattgatcttccttttctagtttttaaggtagaaacttagattaatatttagatctttcttcttttctaatatattcattaaatattataaatttccctctaagaactgcttttgttgcattgcacaaattttgatgagttgtattttcatttttctttaattcatttttatttcaaatttcttttgcctcatctcctttgattcatgtgtttcttatttatattttaatcccataatgatctgagagaatactttgtatgatttatataattttcatgtgttaagatatgttttgtgacccagaatttggtgaatattttatgtgaaattgagaagaatgtgtattctgctatggttagattaagtcttctataaatgtcaattagatccagttggttgacagtgctattcagtcaactacatccttactgatagcctgcttgctggatagaagggttcaagtctttaactaaaatagtgaattaatctatttccccttgtagttcttctagttttagccttacatattttcatgctgggtttacaggcatcatacattttaaaaattgttatgttttctggaaagttgactcctttatcattatataatgctcctttttatccctgatatttttttcttgcactgacgtcttctgtcttctttacctgaaattaatatagtcacaccatattattttggataagtgttagcatggtatatcttactccaccatttatggcacccacgccattatatttaaagtgagtttcctaaagacaatatatactttcatcttgtttttaaaaatatacttcgacaattgcttttaattggtttaggctatttatatttatagtgatttttgagatttctggattaatacctatcatatttgtaaatgttttttagtaattgatgacctgggtttttgtttctttttctttgccttccattttgttttttcatttttggatctaattaagtattttatatgatggtattttatcttctctgttagcatatcaattatgttttctagatatattttgttagtgattccctacagtgtgctgtacatttacaactaatctatgcctactttcaaataatactgctcttgactagtatagataacttataaaaagtacttccggccgggtgcggtggctcacacctgtaatcccagcactttgggaggccgaggcaggtggatctcaaagtcaggagatcgagaccatcctggctaacacggtgaaaccccgtctctactaaaaatacaaaataattagccgggcgtggtgcaggcacctgtagtcccagctactctggaggctgaggcaggagaatggcttgaacctgggaggcagagcttgcagtgagctgggatcatgccactgcactccagcctgggtgacagagcgagactcaatatttttaaaaaaagaaaaaaagtacttccaattacttattttcatcccttataacattgctgtcattcatttcacttattcataaactataaccacccagttatctgttagttcaaataaaaataagaaaaataaacattttattttacctttatttatttttttctgtacctctctccctttccctaagtaggtctgagtttctgacatataattttccttctttctgaagaaggcttaacattttttgcaaggtatgtgtactggtgacaaatttccttaatgtttgcttatctgagaaggaatttctcctttacttttgtagattaaatttcactggctacagaattctaaattggtgatggtgggttttgtttttccattaacatttgaaatattgactgccttctcttgttttcatagtttctgtgtggaagtctgtaatacttatacttggttctctataggtgaggtgttttcccttcccaccattgcacattcccagtctcttttcaggattttgttttgattttgtgcagatttaacatgatgcataatgtagagtattttccatggttggtattctccagcttcctggatctgtggttttgccttcatcattaattttggaaggttgtcagctattattacttcaaaaccttttctatatggttttctcttgattttccttctcgtcttcctataatgtgtgttatatctttttaaaattgtctcctagtttttcaatgttctgttccactgtgtgtttattatttttctctttgcttttcagtttttagtgttgctattgatacatctttaagcatactgagtccttccttgagaatgttaaatccactgatgatcatcaaaggcattttttacttccatttcagttttttttttctagtacttcctttggattatttcttagaatttttatctctctgcctacattacccatctgttattgcatgttgtgtactttttcattagatcctttggcctaacaatcagttaaattcattttctgatcatttaaaaatctctgctgtatctgagtttgattttgattctccctttgtctcttcagatttaatttttttttctttttctttttagcataccttgtagttttcttgtgaaaagctagacatgacatattaggtaaaagggattgacataagtaagcctttagtgtgagtttttaagtaagtttttttcctgtagctagcagtcagtttttgtttaatgttaactgtagttacaggtgtcagaggctaaaatttccttctgatgcccttgtttttgtcttccctgttgtccttggacttccctagagacttctttctaaataaattctgaaacatgtggttttttgtttctattctcctgttattgtgtaggatccctgtttatgtgtggtaaggtgtgcaggaaagaaagtgttttattattctatgatgagagctcaatcctctagtgggcttgagccccagaggtgggtccttcacaagtgatttttagctttttttttttttccccacacccctccccttacatgagacaagctagagaggtttcaaattaggtatttccctccaatgttgaatgttagaggaagctgtaattgggtatttctcatggtggttaggttctggtacaatagttttctctggggaaaggcctttgttaaggagaacagaacattctgagtatattttaaatgaaaactttttcttttcccctgccagatgcattaggggattttcctcatcttcaccatgataacctctagaggtttatggaaggaaaacttatgaaatcatggggatccttctaaggctggtcctgcagaagtttttatatttcaagcttgtccacacccagtgtccaactgttagtcaagtgatgttgaagtgttttaacttgtttctgactccagcaatggcttctgctccctgtaatctataactgtatttatctttctctgcagtttttaaggtagcagtttgccctgtgacttccattttccaaaggctctaagaagacttgttcattttgtttcactttgttctttttgggaggataacagcaataactgctgagctctttacatgccaaaaaagaaactaggaggtctatgacctgtttttgataatcacatatgactttgtagaaatcaggaacaagctctttgacaataattaaggaaatgtcagtcagataatttcatatttgaaatacagtaaattttttaaaaacaaaatgtgtatctttttaaaataaacaatattcctggcacacagtgatgctatatttgcatattcccttaagaatttaaatattgtgtaatttttctatttgctgtggcaataatacaattgagtgaattcttttgcacttcaaagtaaaaaaaaaattagacacaaaatgttcctagtgagattttggctaatctgatagacccatatgtaaatgtgctgtacaaaagtctgaatattttaaaactgttaatgcatgaagtccattttaggttggttccacaacctaaatgatactcactaaacctaaaaaattcagatgataatttttattataaacattggggaatatatacatgcattttcagtttctctcatatttcaatttctgtgatcttataaattcaacaaacgtttatttttctgaaataaagacatttatactcaataaaatactgtaatattacagatctcctgaataaggctctttctagtgctagatctcagtagccttttttatttgttcagagaatggaggaaggcaaaaaaatccaaaaaatatatcatgttctatttgtataaggctttacattggataaaagaacactattgatatctgaatagaactgttatgacttatttgttgttcttgtcattgttttacttctttaaggttggggcaatgcctgagcacactggtttacacctgtgatttcagcactttgggaggccaagttaggaggattgcttgagcccagaagttcaagaccagcctggacaacacagcaaggccccatctctacaaaaataaaataaattagcttggcatgatgtcacatgcctatggtaccagctactgaaaaggctgaggtgggagtaatgcttgagcctgggaggtcaaggttgtagtgagccatactttcattactgtacttcagcccgggtgacagagcaagaccttgtctcaaaaagtaaaaaaggtgggggaacaaaaataaaaatttctgtacagcaatgtagcaaagttccagtataccttatataatgttagtcacctttgtgtgagattctcctctattcagagatgtgagtaaatagatgcatattaagtacaattgtacagtataaagatcccagcaattacattttttttttttttgagacagagccttgcttggtcgctcaggctggagtgcagtggtgcaatctcagctccgcctcccaggttcaagcgattctcctgcttcagcctccccagtacctaggtctataggcgcgtgccaccacgcccagctaatttttgtatttttagtagagatggagtttcaccatgttggccaggctggtcacaaactcctgacctcaagtgacccacctgcctcagcctcccaaagtgctgggattacaggcgtaagccacttcacccagccaacattttaaaaaatgccctctaaatcataaaaatgtccaacactaatttaaatttttccccttgaatcagtcagaatttctcctgtatagggatgcattctgaccgtagcacacattgggaaagtttccatttctacacagtggtggtgcttatacgctcctcagggaatgtaatcatactgctgaattaattgagctttaaaagactttgtcagtaaggaatttgataagggggaagaaaattaaacagggtcctaatattggcccactggaggagaactgaaataattaccgtgcagtttccaattccataatatcatgccagagtggctgaacaagctcacagaactatcattccctagctcaggttatggtcttagtaaatctcctgagtgtaacgtcttgaccaaaacagacaccagtggctatgaaaaagccttcacaatgaagtcacagggataaaataaaagcgacagtccaagttgaaatgccacacaagtcgggctttcatttaaggacaatgctttcctgcccctgtgcagagcctggtgtgcattagagatggatggctgatttcctagttaacctgtagcaggtggcacaactgtataactgggccctctagccataatcattttatttttctggtgcctgtcctttcccatttccccatccctaactcctctgatagttcagtaacttcatcttccttgttggtgcttggagtcatgactggaccatatttctggtgtattttatagcatcttgaatatcctggaataaagtttctaaataatgctaataatgaagtctcttgctgcctagaagtcttggagctaggagcttggctgcaaaactcaaagtaaaattcagaaaatggtgttgtcttggactgaatttaacagaaacaattcctgcttatgactgtagactagactgttaactgggccttgacatgggattggcttagcccctttatattggattaaaattgtatttttatatatacacacacccctgtgtgtatgtgggattgtgtgtgtgtgtgtgtgtgtatatatatatatatatatatatgtatgtatgtatctctctctatatatatacatacatattcttacatgtatgtatattttttcctgggatttgtcttaaaacattctagcaaagcaagaaactgaaagttgacattttccccctgaaatatgctctaatcaccagtgacagatttaaaaataaatggctgagctatttaacttggcaagattacacactcaagagcaggtttcataaatatttaacttatcatttccatattttatacatggcaagcattcacagaggcagtgagatctgtgtggagagagaaaagactgcattcagatagacctgagtttgaatccccattcaataccatcctcactagaagactgtcagcaggtattttcatctttctcagccttgttttctggtaaaatgggcaacaaattcacaaaccacaaggttattttgaaggttaaataaaatatcaaacaaataccattgatgacaagtacctgacacatgagagttgcttgggaaagtaagttatcttctcttttaccaatattcaagatactgtggagttgcttggcactggcagtatgagtacattctgccaacttacgtggcaagttgattaatggatatgaccattataacctggtcttagagagggttcagctaaccgttaaagatgcccagtttcactgtgcctgaagcctcccctcccactttcttggccctaaggaaaagtcctgatatccatcggttatttattttcaactcctgggattccttcccatgattacagtagtttgatctctcaatgtgacaagaaaagctgaattattgaagaaaaatctcccagtccttcaagtgtaatttttttagattaaaaggagcaaccgcatttagaatgcttatgctaaaatgtattcattgtttagttggaattcaaatgaactgggtgtcctgtaatttgtctagtaatcctacctgttctaggtttctgaaatcactgctttaaggcaggcccaatgcctttaaaccaatcactgggccccagtaagccttttatctggtaggtaagctgaataggggtggagtgtgtgtgtgtgtgtgtgtgtgtgtgtgtgtgtgtgtatgtgtgtgtgttcctattacaagtaataaatgaaaaagtcatctccattttctcaaagcagcatcaactttagaatgagaaagttgcataattgagatgagaacctaccactgtctttctgacctaggttatatacatttagcattgtacatacgtgtgcacccttctgcagtatacatctagactggcaattgacggagatatgctccaagagagcaaagcagtttctccttaagcctacttctagtctggcctgctaactacctattaatgtttttctgaaatttaaaattaaatgacactagagtgaaataagcaaccagcgattatagggaataaaaggtactctgaacacatgggagtgatgatagagtctatgcatcccaggcacaaccactgatcttccactatgcatgaataaaccttttaagactctcagctactttaaaatattttgcctttcccaaccttaaaatattttttcagatgatccctaggaaaaaacagtgtctggaaccacaagccattatgaaatccttattaagtacacatgtaggaaaggaaagtcatcaatgcatttcttggctaacacaaatgtagatcagaaagacttggagtaaaatctctgcaactttacacaaagtgaagaataccataatttgtatcaatatccatgctattcacgtgactgccctttcaccacttgagaatcgtgtaaaaatttgctcagctggaaaagaacatgacttctgaagaattttagagatgaccaaatgaaaacaaaaatttctcaaattactgtcttatgatagtgagaatgaaaaaaaaaagcacagataggaactagagccaaagatggattagaacagaaaaataaaagatgtttgaaaatgaaaatagaaaaatttccagtttctgattcaacatgtaagaagatcagaagttgtcattcccatacttatgacatgtaaaagttggacaaactaaaactcagggacttttcttggactcaccagacacctgagtttgtgaaaatgaattctgaaaaactagaggctgaaggaactgtacgtaagtactgtactctagttgataaagtactgtactctagttgataaagtacttattttccatggagatatgggttaacagttctgaaatcatatcatatatagtataattgaatgttttaagaaactgatggtagttggtggaagccagatttgttgaagtgagagtttagagatgagtaaggggaggagactagaatgatccatgtggtaattaatggagtagagttggatacaacagcatgaactcctatttagatcgacatatatatcaatgtttacatatggaaacatttatagatatgcatatatacatggaatagcatattcacatgcagatctttgccctgtcagttgagagagcctagaagcaacgacaccccagtatctatgagcacacctgtaactcagatcttggtttctaaaactattttccaatttttactggagccagggtcccttgaaaaaataagtggcttattctaggactacagcagggaatatacaagatgagctggagcagcttgccaggaaatataaaaaatgctaaaaaaatgacaatgatatgggcatgtcataatattcagaagccaactggaagagttcccaattttcaaagctggaacaatttgagcaacaaaataaagttagattggactgtaacccagtgtattaaatggaaatccatgtgcatatgttggtataaaaaatgattccataagtaaataaacgggaaaaatagacaaatctctcatgcagaaaaatttcaaataatttattttgctactccatctacataaataattgagatgaaacgtaacttcttactccttaaatgtaggctacacatagtgacttttcttccagagagcagtgtatggaaacagaaaaaaaaaaagtaacattacaattgagaaacctgacaagcacatgtcaagtaaggtgatcaaggttaatatcaacagtgataagtcatattgatatgctattataatagcactctatttctctggttttctctcagaaataaattaccctagtctagtcatgagaaaatcatcagccaagtcccgattgaggaacattctacaaaatacccaaccagtaattctcaaaagtgtcaaggtgattaaaaacaagaaatgtctgacaaactgtcataaacaaggagagcctgaggaaactattaaatgtgatgtggcattccagatgagggatttgaatagaaaaacagcattgtttaaaaactgaggaaatctgaatgaagtatagactttagttaatattgcttcagtgttgattcattcattgtgacgaacgtactgtactaatgtaagatgttgataggtgaaacttggtatggaatataagtgaaatttctctactatcttcacaataattctgtgagcctaaaactattctaaaataaaatatttaaacactacaaatagaataaagagaaaacatgtaaaccattatttatttcatcagtttacttgttttgaaaataattctgtgcttcttctatttcctgaattttataagaaataaatatgtgagaaaattcaacaaccagtactcaaccaagtcaggtgtgaagatactcacttttcatcttctttgcatcccaacataattatttcagctttagagaatgtggttttgttgaggcaaaagtatattttgaatgctgatgatgtaggtttgtgtggaattcctattaaggaatgatcaaatgatctggaaagtagcaactgtttttgagattcttatttaaagatttaaataatttcatggacattaaagtattttgtaaactatatagatttcagtataaatataaatcattgttatcgtgtatgaactcattaatttattttttcattaaaagataagcttttatacattgtcttctccacccccaccacccgccacctctctatatatatagagactggggggaagagaaccggaagaggatgtataatattctatatatatatatgtacatattttttaaccaagccctatgcactgaacagaactacaatttcagttttgaaactgtctttctgaactattttactcctcatcgggcagccccgtggaggttttactgtttaagttttacttcctatttctcctgagagtatagaatggcattgaaatggcagagccattcaaaccatctgaattgatccaatatttcaattcttccaacttttttggtgccttttaggataaggctatttctttacctatgtctgtctttcaggagcaggttcttgcatcagatcaattttgtgaactggtttgtttcacctgtgaatgagttacaggtcctgtatatcatggtccttctaggacccaccctcatcttgataaacagacgctggaggtttagatgcacctgtggatgatagaggacactcaactttgcaaatggaatgtgttgtctggaggatgccatcatagaaacatgtggttccacttagtatttagtgttttgaacagatattgaggagcaggagaccctgaaaggtctccatagtgagagtgtgccaaccagagggcatgttacttcttttttacattcagttgtctcactagcacctcaaactcaacatagccaagttgaaattatcatcctccttccatattgtcccatccccctattcctgatgaatgacatcaccatccatccattgaccaaattgcaatcgtatgagtcatctttgacacctcctcctctctctcatctgacttgcaatccccaaatccagttgattccaatgttcctaaacatctctcagagtattcaatgccatttgactcggcagggaaatgtgataaacaataaagctactgtaacagcttactaatattgaccaaaggtcatccccttccaatccattctccacagaacaaagccattctaaaatacaaagatgatcatgccacttcctgcaatctcccagccatgcccattgtatgactcctatgctgaatgactttaagtttctttaatattacatgctctctttcccactgtgggttctacagatgctgtttgctgtgtctgaaacatcctactgttcctctctccacttaccaactaagctttcatctttcatcctccacctaatctctactctcctttcaggatcatcagaggtattacctcttacaaatatctttccctgccttccaaatcctgtctccaaagcctggattatgtacttattataggttcccacattgcactcagtacattgtctccaccctctactagcttggaaaaatctgcgagagcaagaagtatgtctgttcatgttagagttacctctaatgcctgacttgatacctgacaacatagtgttgctcaatcaataattgtaaatacctgaattattaatgcatgaataaataaatgatttggtaaatatacaaatgtatgtattaaaaacaggagagaaagaaatggaaatatttgtataaccagaacatcaggcaattagcattaggaaagctttttttttcttgtttaagtaggttaaaacaggccttaaaagacaaaaaatcgtggaacattaagatctctctcctttcccccctcctccttctacctgtgtgtgtgtgtgcacgcatatgtgcacttgttaaaggtagagagagggccgggcacagaggtcaggtgggcgggttgcttgaggttaggagttcaagaccagcctggccaacatggtgaaaccccatctctactaaaaaatacaaaaattagctgggcatggtggcaggcacctgtcatcccagctactcaggaggctgagacacgagaattgcttgaagccaggaggcagtgagccgagatcatgccagtgtactccagcctgggcaacatagcgagactgtctcaaaaaaaaaaaaaaaaaaaaaaaggtagaaagagatggtgagagaaaattgttggcaagattccagtttctttccactagaaggcagaaagcactaaacaaatgtcaaggcagggacctaggtttccagaacccaaaaggagcattgggagtttgtcactgagacctcagaggcagagcccaagaccagaaccgaactattactatgcggacttgatgttcaatgaatcaatcgcctaagtatccctaaatgctccactaccctgtgcctctctacaaaccccattataattcattcccaagccatgatcagaattggctcatcagtttgtgcggtggtaatgaggaaggggtaggaagttgggattcagtgggtctaccataaggcagaagaggaagcaaatcagacacattccaatgatattatctgtttggttttgcccatatctgattttcgaagtcttctatgtactgaaatcaaatatctcacattaaaaaaaaaaaaaagcttttaaagattgtaggttgacacagcatagaatatcccttccttcttctagaccagtagcattcaaagctacctggtagtgtaattaagattttacatatttcaagcttcttcactgtaactcacagcagcttggaaggtaggagtaagcttcatgacaatgatcctctgcattttgatgggtacaagctgttctttgatatcatggacaccccagcttttcaaaagaagattcttggctgtttagcagttcagccaatccatgtaattgctttttccatgttacataagagtaaaagtctcctataattatagggataaaagagacttgatactttccagatcaccagagcaggaagaaagaagaaaagcatgactttttggagtgattactcatcacatgccagacacaatgctgaaaactttgtatccatcatatttttatgccacgaaaaccctgtacagaagacataagcacccccattttacagatgagggccctgagactaggggaagacaaagaattcctcaaagttagtttacttagtacaaattagaattggtctttaaactgactccaaggaggatggccttttttactctaccacatcccctctccaacactattggtttgattttctgttacagaagtacaggaagacagtgtttcttttctagctatgcaacaatgacatgtggtggttgaaagcatggcctctggagccagactgcctgtgaccatttactttttcttgaacttgaacttatactttagtttctctgtgccctaatcttctcaagtgcaactggggttaataatggtcccagcactgttgaaaggactaaatgactttgcacctataaagagctttgtattttaagtgctccataaatattcatgttgtagttgtcattgctattgttgttgtctgtgaggccttttcacagaggcatggcctcgcagaatagggacaagcatgctttaatgctactcctgtcttcttaattcccagtagcagaaaaactggaagactcctttgccaagggttattattttttaatcaatctacgtagggtttatacatagatgatgacagagagaggtaggtacagttatttatagcctgtgagtcattatgaaaagtcactctttctttgcttggtcagagcagtgagaatacatatatctgcaactccatgtgtgtagaactagcagcttaaactggaaagatgacctattgccttagtctttcccagagagaggcttgccctacacccccttttgcagcctgcccaggctaatgcaactagcgatggcaaggcaagcagggcaggctgccatgcattttaggggatttgagcagtcaggcagatcattcagggagagattgttttaaaggtttagctaaaagccatttatccacctcatttcaagcacagtattggctccaaagtacagttggtcctccatatccatgggttctgcatccatggattcaaccaactatggatagaaaatatttggaaaagaaaactccaccaagttccaaaaaacgaaacttgaatttgccatatgccaaatatatcaaatccacgctaatgaagtgatgtgtaggcattgtattaggtattataagtaattcaggaatgattgaaagtatataggaggatatgtgtaggctataggcaaataacacaccttgttgtataagagactttagtagccttcaagtttggtatctacaggggatcctggaatcaatccccaagcatatccagggacaactgtgctatattgtgatgaagttccaccacttagctttatagctgaggactacaagctccaattatcttagggaatattctggtgaccaaataaataaaaactttctaaaaagtgatagtcacttgagcatccaagaagtatctatcacatccttaagtcattccattttcctttatatctctctgggtgagccatcttgtcctgaatacaatttgtaatgccgggtaattacttcctgacagaaatttcttcccatttcattctctgtgtgttaagctcatttgattacaacaaacaaaacaaaattcagggacattgattaatgcaataagagcaaaataagtaattaaaattaacaagtttctaactttgaggcctggcctctctcacagagtctgtggcaatattaaagtgtgattctagcagaataaaaacagttcttgtctcctgaaatgtgaataatcctcagtagatctgcctttggattggacatccattgaacatgtctcaactgcactgtgtctctttgtctttattttctttatctttgggtcattcccccaattctaactgacctttgttatccttctggtctccagtttagttttctgggaagggctctccctggctcagttcctcagcaccatcactacttgagcagagcttttccacctgaagtgctcaaaggactgcccatctgtccttgctcagggacccccaacacggactgcaaggctttagaagttgaatccccagcacagagctctaatcataggtgccgcagaggccttgtctccttgctggtgctgaagggtggtggcttccatagcctgacagtctctttatttacccagcacaataaaggaactaacattattcttgtggcaattcaaaaaaatacttaaaaattagtttgagacattatttaaatttttattatacatcccctgacaaaataatttttatttatggaatgtatttttttattttactttaagttctgggatacatgtgtagaacatgcaggtttgttacataggtatacacgggctatggtggtttgctgcacctatcaacctgtcatcattatttctcctaatgctatccctcccctggcccccaccccctgacaggccctggtgtgtgatgttccccttcctgtgtccatgtgttctcattgttcaactcccacttatgagtgagagcatgtgctgtttggttttctgttcctgtattagtttgctgagaatgatggtttccagcttcatccatgtccctgcaaaggacatgaactcatcctttcatatggctgcatagtattccacagtgtatatgtgccacattttctttatgcagtctatcattgatgagcatttgggtttgttccaagtctttgctattgtgaacagtgctgcaataaacatacgtgtgcgtgtgtctttatagtagagtgatttataatcctttggctatatacccagtactgggatggttgggtcaaatggtatttctgtttctagatccttgaggaatcaccacactgtcatccacaatggttgaactaatttatactcccaccaacagtgtaaaagcattcctgtgtctccatatcctctccagcatctgttgtttcctaactttttaatgattgccattctaactggtatgagattgtatctcattgcagttttgatttgcatttctctaatgaccagtgatgatgagctttttttcatatgtttgctggctatataaatgtcttctgttgaggagtgtctgttcatatcctttgcctactttttgatgggtttttttttcttgtaaatttgtttaagttatttgtagattctgcatattagtgctttgtcagatggatagattgcaaaaattttttcccattctataggttgcctgttcactctgatgatagtttattttgctgtgcagaagctctttagtttagttagatcccatttgtcaattttggcttttgctgccattgcttttggtgttttagtcatgaagtctttgcccatgcctatgtcctggatggtattgcctaggttttcttctagggtttttatagttttaggtcttaagtttaagtctttaatccatcttgagttaatttttgtataaggtgtaatgaaggggtccagtttcagtttttctgcatatggctagccagttctcccaacaccatttatttttatctatttcagggatcagcaggtttttttttttttaaaagtaaatctcaaacttgttcaaagagtaaatatctaggctttgttgacttttactcaagtctgctattgtagtacaaaagcaaccatagacaatacaaacaaatagatgtggctgtactccaataaaactttatttacaaaagcagctgtgtttggcccctgggctgtaatctgtggagcctgatctttcccagtgcatgtgtacccatgctgtgctcacaccccctcacactccatacccattttgtacatctgtgttcctttgttgcctatattgcatagctcactaatctgagaaggctggatttcaccgaattgcatgggagtcccactgttgtcaagacactcatggtctgttaagtggaggaaaaacatgaactatctataggagaaccaatgtctcagaatcatcaacaaatgcatgcatttgggagaaatttctagtattctaaaatggatcgttttatcctagaaatggtgagaatggcactctcatcacacaaagcacacatatctgcttaggtacagacatttgctgaatccgaattataatgtcctcttctgccaaccctgtaagatgctcacatgctaatggtaggggtggaggaatggtatgaaacatgaaatatcttctgctttgacaactgtcttaactctgttgttctctcctaaaatgaagttgtgctttgagccactctatctaaaactaggctgtcatttctatgtcctaagggatgcaagtaccgttttacctttcagaaagcaaattttaaaacaatccccaggtataagatttatctttccgagcagaggatctgcaaacagtgcctgcggacgtgtttactggttaaattttattccaactatgagctactaagtcttccagcaattgttctttcttaacaagtttgtcttccttggtgactgatggtttctacttgttcacttgatcagtgtagcatttgattccaacagaaatgtgcagtggctcacccctgtaatcccagcactttgggaggccgaggcaagaggatcacttgaggtcaggagttcaataccagccaatgtggtgaaaccccatgtctactaaaaatacaaaaattagccaggcatggtggttggcacctgtaatcacagctatggtggctgaggcaggagaattgcttgaaggtgggaggcagaggttgcagtgagccgagattgtgccactgcactccagcctgggagacagaccgagactccatctcaaaaaaaaaaaaaaaggaaaaagaaaaaaaatgaatctttataatatacaacacaaagagggattttgatgggcttttagttctcgcagacccccctgctgggttgcctaaacttgtagtggcaatagagcatccagaatatctgcccatttcttccttaggtacatgagcttccctgtggctttagatcgttcataattgttgggttcatccaggagtgtcactttgtgaactttttctcaaggtaataacatgtgtgagtagcacgaggcattaaaagaaagaagagagatgggagtgtcctttagatgtcctcagtactgttgttagaacctgcacaccagttttttattcacagtttccccttgtgtggcaatttatttgcagtgtagctggtaatatttgtgacatagaatatgttatgctatgacgtacctactatggttagcatagtggtggaatttaagaagggatatttaattaatagaatttataaacaggactatctgtcttcagagacacttcagggataacgataaacttcagagatactgagaattgcaaggggatctcagtctaatgacttttgagtgccttttcggatgtgaacaaacccagcaatagggtggataatatgccttaactgggtccccaagatacttgattgtgtatattgtctggatgttcaggaacacatggtcttaatttcttagatgtctctattgtgtgtgccagtttagagttcagtctgggtgcatttatgttatatagttttttccatattttcttttagggtataggaacaaaacagtcagcaaaactgccaaggtgcttgcagatcaaagtgaagataaaaaatgagtggagtgattgcaacacaaggtgacacttgatccaatggaggttactttcactggctttcctagaagctcatactgggaaccccatctatgggactcgtggtgggtggtgggggatgacagaaaacttcctcttcatgaaaatcttaggtctaaatgacatgcttatagtttggtggatggattgagagaagcagggaggcctttccaggcagaaggaacaaaatgtactgtcatttggaagtgacagcaggatgcactgacaggagcctggagcagagtataggaggcgatggcaaaaagaaagactcacaggttaagacaggcccagggcatgaaggacaagcagccactgcacacatcccctccactaactgctttgttctgctccctcttgcagtaccaatactatccaatttttgtctatactagaaatttgggagccatgcccgatccaatttccttcatatcacccatttactccatcagcaggaatagaaagcttaccaactttatttacatattcatccatcctttattgataaaataaatttatttttgagatactttccatctgacttcaaggttaaataaatgttaatgaaggaggtaatgaagcaagacatgcttgaactttggagccagacacaatttgggttggaatcttgcctctacctttcaccttctgagtatataaccttgggaagctgtcttgggatcttcagacctcagaaaagagcacaaagaagttaattatatgttcctcagagtacctgccacagaattattaaatattcaatagtggaaattcctatatcctcacttctccttctagttttcatttctctcctgaaacttcgttcattgcattttgaaaccttcattgactcttctattggattttgaggtccttgagggccaaggttattgttagggcttttttgttttgctttgttgttgttttttaataaaacactttctgtgtttatgtttctagttttgctcagttttggtttgcacgggagtctcctgcagtctgccgtctgagtgcaagagggaggatgaatgatatccctttcagcttcctcaggtgtggggaaaagattaggaaaagagcaaacatttatggcaatctggagttacagcatgtgtttgagtcccaggtattttcctcatacatcgtttagcctctttgagcttttgtttcttcatttgtgaaatgaagataaaattcttctaccttatctggcctataggatcatccctggatatttgccttgaacagtttacagtcttagctcccacctgcccatgggaaggaccacagggatcttgtgcagcatccccaaatcttctgcagcagcactccaagttccatctccttctctccattccttcacctgctttccgacaggtttcattctgtggccagtactttgttttcctctctatggcggctgtttgaaatttaggattccgtaggacagccttcttactttgcaattctgacctcaccgctacacaccatagttcacattaccctcaccttcattaatgtctctaacagcaacaatacaaattgagtaaattcaatttagggtgattgagatgtcacctgtttttattctttccataaattcaagcaagatatgttaacaattgttcggatgtcataatgttatgctagaagttattgggctctttaattgaatgttctcttaatttgggcattggtaaggtaccaatttgagtatgcagacttgatagctgggtttgccaccaccctgagctagtagtgtatgtggatggcataaagaacatgttggatctttccacctctgactggggctctctgtggccagcatccaactcagcaggatcagatgattccggaaacactgactgcttctctcctgcaagctcacagtggagcgtctggcactccctgagatccctgccctgcatggctttttacacaaactgaacaaatcacattctctaaatgagagaagtgcagctctgttacatttcaatcttctaaagaggaggaaggtcactcgtcagagaccttgtggtcatcagcaaatagggtgatccaggatgaagacacacaggcagtaaatgacggtttcttcctcctctcccttctcctcctttccccttgatatccagtcttatcttctcccttcctttctaactctccttttccaatctgttcttcactcgcctttcttctcttctcttctttcccttcttctctccctctttattcttcttccagaaatctttaaatgagtcatgattcaagtgaaaaaagattcttagctaactcacatatggaagcagcaaattttctcagattttgagctccttgaaagctgagcagcataggagccttcacaaccctgtagtccaggcagcagtagaggcatttctctccagttcctgggaatctcatccgacagtcaacttgtgttgacagagtgagtaggactgtggcttttatttatttatttatttatttatttgcatctggatcttgggaagtaagcatgtggcataagctgggtttcttacattgccctaagtcattgtcacaagtagaaagaagtatggttgtacctctgctgcacaaccactcaggcaactgttcctaatgtcttctctgaggccttctttgtcacttcccaagtctcaggtatgggcaaattatcctctatcctaccccattatatttgaattccaatttgctcgtagttcattaacacctaccacactatttcctatttattttgtgtccattcgccagctagattgcagaagttgtgtaattgtgcctcattcgtctttatagccaaagtataatcctagaacagtttctaatgtcagatgcatcagggaacccaataaatgtagatggtaacgttatgctaatcttacattttaattctattagtggtgaaatctttatgacttagtcctgtgagttgcattgaaagattgatctaagcacctcttttgtgttggaaaggagatatattttcaaaatttttaaatattaatacatttttagcatggcatatgatcgttttgaaatacttatttcaatatcccatgttctaaaatagagtgtattaacagaaattttgagatgtggtaaggccaactgatcatgaaatgattgccattgaaaagataatggtcttgagtatggaatcccaaaaaaggaggtaaatgggggtctgggctctggattgggttggtttttatttgaaaagtgtgtgctcgggcaatttattttctatctctaggaactggttagtcctgagaggggaaattccttcagggtcaggaagaaccagatatcaaagaatcagaaatacaaaataaaagatagacttaatgcagcttatgatgccaaaagagattcacttttctctaaacatgaatgggcatgtagaaaaaacagcaatctctacagctgtctgggtacaattgctgtcacaagaactattgccataatgcggttaggacataaagtaaacttaaatactctacatactttttataattggaggttgtctacatagacacagtagagacttgagaagtccccagagaccttaaaattctattcagttcagctgtaaccgtatcctccaatcaccttgtgggtcatgtatggattgtcttgcttctgcatttatcttccagagatttgctgcttttactaattattggagtagcagacacctctattgcttctgcctctcttgaactatgattgttcttatctctgggtactaagtccatcatccttagatcctgtagagcactggctgctgaggcacacttatcaccaaacgcctgttggtgtcactacagagtaggaaccaaattgctctcactgctggatgacaacttgtttctcatctagcatcctaacttatctggtaaggaaatggataactgcagtatataattattgtgtatcagtaattaactcctcctgccctctgtttaggtaaaagagatgaggcttaaaaggcgcacaatttttaaatgtcaaaagtatcacttgactcaaatctttctgaacttagcacttacaaacttttcagtggaccacaatgtccaacattaaatgctggaaatcaccataccgtgggtttgtaaaacaggccaatattttttttatggatacttttaaggtccatcctagaggcctatttatataaacacttcatgccttactctgggaacttatcactaagattttcttcaaagacctggtgaatcaggattttccattcatatctgtgaattaaggatacctgggggtaatctctgtcactgaatacatcaatatatttgccagttagacctcttctttgctggagaatgctgacttgcactttttgtataggtaaggtttatcaacaagatttgtacaaggtcaagattgggagagctgttagtctgagaaatgccaaatatcagaatggggaagaacgagatcgtctctagaactcctagttactcagaggcattttatttcatttctttcatatgatttcttctttctttctttgttgtcttttccacacaccttacagatgatcagtattctatttaaaatgtacttaccacaagtacacaaggctctttatctcaacagtgattatagttaggcaatagtagaaataaaataaatgtccatatgactttaccatatgacagaatattctgcagccacttaaaaggatgagatagacctatgagcactaacataaacaacgcccatgacttattacaagttttagaaaacaggtaatctattatttataatagcaaaaaatgataacagtaattctatgttattatttttctctttttttttaaacggagtctcgctctgtcacccaggctggagtgcagagtgcagtggcgcgatctcagctaactgaaacctctgcctcctgggttcaagcgattctcctgtctcaacctcccatgtagctgggactacaggtgcgtgccaccacgcctggataatttttttttatttttaatagaaacaatgataaatgagccatagctacctgcaacaacatattgaatcttataacataatactgagcaaaaaaaaaaaatctagacatataaagaacatatggtatgattctatttacataaagatcaaaaatagatacaactagcttttggtattagatgtcagtttaatagttacatgggtagagaaggtggctagtaattaggaagcagtgtatacaggggtatggatcatattccatttcttggtctgagcattgagtacctatgtgtgttcattttgtaaaattttctcacagtgtaaatttatgaattatgcatttttgttatgtattaacctttaaagtttattgtaaagggcaggaatttgaattttgaaaaaataaaagattgtgatgtttcacaacatggacagtaatgaaaggatattcttaggtgaagtaagagatgtggttcagcaagaccatgtgcaagtcagattccaggggaactagaaaccatgagcatgggtgaaactgaagacattattaagtaaaataagccaggcaaagcaagacaaataccacatgatatatggaatctaaaaaaagctgttctcatggaaattgagaatagaatgatggttatgagaggccatagggtttagggggaagatggggtcggggagatgttggtcaaataatacatatctgcagttggatagaaggaataagttcaagagacctattgtgcagcagggcagctatagtcaatgatgatattttgtattgttgaaaaatgcccatagagtgtatattcagtcttttccccacaaaaatgataaccatgtgaggtaatgtgtttgttaatcagctcgatttaaccattccacaatgtatatatacttcaaaacattgtacacaataaacacatataatttcatatgtcaatttaaaaataagtaaatatatttaaaaaaattaaaaagacactatgagcaagtagaggaagacaactgttaaacataggagtaggttacaaagcaggcagtggaggggcagggataacaaaatctccaagaagaggggtgagccatgctattggatttccatctgtagtttacatatatccttaagataaatctttgaaaaatcaagttaaaatgaattaagttgaatattatcagcactgatatttataaaagagattatatatttattattgctgtgactatcattattatgattcgtggagcatcagtatgactctgtacctgaaactaatgagtttgactacaacactcttttaattcttcatttttcttatgcacttgaggaattggaaattgttttcaaatagtttacatgttacctctcaaattcagtttttacaatgggttctatgatatattaaaataatggtaataatatagtagaaaccaattatattttattaacactggaagtgagccagacactgtgctcagtaaatgcatggtacaaagcatctcatttaatcttccagtgacccagtaggcagatattatgatcatcaccacatttcacatcaaaaactgagtcatagacaggttaaataaaattgccgaaagtcaggtaaatagagcgagaccctgggaacagatctgtgctttccgactatcagtctgcactattcaacgtggtagccacaaacatgtgatggtcattaaaagaaaaactggagaaaagttaaatttaacagactttaatagagcaatttgtgaaggggtagccctctgcaccaaattacattcagagtgactttggcactgccggaaggtgtaagagaatttacggaagcagggaatttatgggagaagggaaagtggcctacagaaaacagaagtgaggtacagaaacagctggttatagtaactcggcattcatttgaacacagtttgaacagttgactgactgtgattagctgaaactcagtgattggtacaggagtaggttacagtctatttgggcatattgttaggttaaaattcactatgtacagagaaaccattagaccaaacttagaatctgtaaggaggcagttttagggtaaaatcagcacagttgaacacttgaaacatggctagcctgaaatgagctgtaagtctcatatacggtaagtctcatataaaaagccccactggatttcaaagacttagcgccaaaacaatataaaatatttcattaatattttatagctattctgtattgaagtgatactattttatatatgttgggtcaaataaaatgtataattaaagcgaatttctcccttgattgactgattgattgattggattgcttctacggtgcctactagaaagctttggaagctgaaattatacatgtggcttgcattatatttctgttggatcatgctggtccagactggatgctctacttctagacctgaggttttcaacttcagcgctttaggtagatttgaacgtacacagatctagcttcctagtgctggaaattcagatctgctctgggctggggttcagttgttggtgtatttgagaagctcccgaggtgtttctaatgtatagccagaggagagaacccctgcctggagtccatatgcctgctctatgcagtctgatatccacctgactcgagacagctcctgatgggatagttacaacttaagcctgggaagtcaaatagccacagggctctcagcctgcgcacctatgcaaagagctgactttgctgattatgtttgtagatcttccaggatcactgccaatacctgtggtaaaggagttagattcctttagcttacacctcatctgtctgagagaagtgaagccccattacaccaatatggagaaggttgtgtgttaccttggtcctgaatgttctgtgaagcaaagttaaacggtctttagtgggttagaatccctactccatctaaataggtcacagctagaagattcccttaaaccgctgggtcagattctccctgttgtcaagaaaatgaaatgttattgttccaagtcacatgtcttgctcctagaatgtgactttgccaatgaacagtgaatcctaagtgataaaacctagaattgagggtaaggagtgggggacagctattataggttcaggaaaaatggagttaacagatcttttaaaagtgaactcggacaccacagactgggattatcttagcattgaaaactcactggtagatataacttgatgcaggttgctttttacttataatttatttgtggaagaaatagcacttggaaagccagtgcatattagacatattaatgagaagacccagggcttttcattttcttttcaaaatatgtcttataacattcacttatctatagtcagccagagatgcactgtttgtgaaaggaggggaggagataagcggttattacaggaaaggtttatatttggtgggggtgcaggggaagaaaggaaaatgacaggctgagaatacagatgtttatgaatttaaactgttatttacccttaaatatcaactttaactgataatgcacatctaaaagcattttgcgtagaaataagataaactatagagtatcaacattattataaagtaattatttcagtttttcctttgttgttgttgttgtttgttgttgttgttattggttttttgttgttgttgttgttgtttgagacggagcctccctctgtcacccaggctggagtgcagtggtgcaatctgctcactgcaagctccgcctcccgggttcacgcctttctcctgcctcagccttccgagtagctgggactacaggcgcccaccaccacgccctgctaatttttcgtatttttagtagagatggggtttcatcgtgttagccaggatggtctccatctcctgacctcgtgatccacccgcctcggcctcccgaagtgctgagattacgggtgtgagccacggcgccccacctttcaatgtttttttaagtgtagtattatgcagttgactgcaaagagcaagaaaatgaatccctagggtaaatgtaactttctacctcctcccccacctcaagaaattgctgcctctttttattgccccaccaagcagaagaccactggtaaatgtccttagacatccagctcagaagctattgagttcaccagaggcttttgtagtgaggccctagtgcacagccagcattagccacatacaactatccagaaataaagatcatatccttgtccttgaggggcttttgagaaatgggtatgtgcatttttggtacaagaccatgcagttatggaaaaggtgcaaaaggaatgcagaagggaagcttgggaagaattttcaggcttaatagtatttattctgagcttttagggatcggtgggcagattaacttgctagggctgctgtaacaaagcaccacaaactggtggctcacacaattcttttgttttccagttcttatcgaggtattagcagacttggtttcttctgagggctgtgaaggggtaactctttcttgcctctttcttagcttctggtaattggctgtcactctttgatgttcctaagcttgtagaatcattgccctaatctctgacttcatctttagatgatgttctccctatgtgtgtatgtgtctatctctgtgtccaaatttctccttttactaaggacacagtaatattggattaggatccattttcatgacctcatcttaacttgatcctcttcaaagaccctttcttagtccatctgggctgcataacaaagtaccctacactgcatagcttataaacaacaggcatttatttgtcagttctggaggctgggaagaccagggtcaagatgccagtaaattgggtgtttggtgaaagctcagtctctgcttcataaatgatgccttcttgttgtaccctcacatggtagaaggggcagggagcttccttgagtttattttataagagcagtaatcctatctgtgagggtggagccctcatgacttacccacttcccaaaagccccacctcttaatatgattccatagggcattaggtactaacatatgcattttgggggcacaccaatattcagaccatagcagacgctatactcaaataaggtcatatgcatatagctactggagtcattacttcaacatcttttggaagacaaaattcaatccataacagtgggagtttcaagtagaaaaagggaaggtgcttctagcctgaataacacagtgtaaaagacatggagccttttagtacctcctggtcatctcagcttctctgcacttggatggtgggactggaggccccccacccccaggcagctttctcagggttgcttgtagcaaggctcagggagctggttctgtcttcctgatattcttattatatgcccaccctgccagggtgccaccctctgtaactgccccaccctgccagtgtatgtttgatctcattgatctcatggtaaggattccttttatttgccttcaggctctcttttaactaaatgaaatacttgtttaaggcatttataaggccattgaactctttgttcatttttatctgcaagttaaaaaaagcatatcctgatttctaaacattctaaatattctccttttcattctcttttctgatcaaggttcatttgcaactgcttataagctcctaatattttaatctatcccaagcatttgttgatttttaaaaataaaattcaggagacctgctttatctaacaataattaatgctggattaaatgcacttaaacttaatccagttaaaatgaggacaaaaaagtcagagtgcaaccattagggagagactgacctacacagatgatgaggttggtttgatggatagaaataaatactagaattaggcagggagaaatgctggagtgaagactcatttcataaatagtgggttcgttattgaatattgttgtattatgatgacttttgcttctctatgtagactcttaacttcagggcctcagataatgaatacttggatagaaaggagcctctgaggtatagttggttgatttttagaatgactataagagtaatcatgcttcattttgatacctagtggcaacacataggatctgatttgcatatcttgagtatgcgggtttccaggtgaaacttttgcttacttatatgacatataggtttgtgtgtgtgtgtgtgtgtgtgtgtgtgtgcttcaacctcacactacttgaagatcagcacatttatggacatcatagttgagctcagtgtcttttaggccaccctaaaaatggtggtacaaaggaaatgttctcaagaagcactagaatcctaggtccctatacctggaggggatatggaggtgccatttagaacagttcctgttccctcacacatgtaggagatcatgctgtatcatggtctcccacacctctgtcctccatacagagatctctctggggaaatagtgtaacaagaactatgactgtgattttctttcggtagcattcttttttctacgtagtacagcttaacaagtttctatggagagactttgagaattttatactgttgcagtttccaaaagaattaccataaggctgtgttacacatctggatctgaactatggctgcccagttaagtagatatcatgctagccaataagtgttccaaggattctgtgtctccaaggacaaagagcacaatttatttttcttaaagggagaagtgagggagagtatgaaactagagaaagtaacattatggtgaaatttcagaacccagcattagaacagtggagagaatctttttggcaggcagcctggcctgagccttgcccttgcccttgccctggactcatctcactccaggactcatctcactccaggagcagaatgcatggttgttgcatgcgtctgtttcaccaccagctgtaactgctcttatcctcttatccattgtctttaccaagaaaatggaagaaatactacacacttcctatttgtttatctgtgagggagagtgtgaaagacagagcccattccccaaagaggtctgcttgtattacatccctcaaaatttctgggcaggaaattcaaaaccacaattgagaaatatagttaccaagagtgaaagtacaagttaaaaaaaatgagttaaaaaaaaaagacataaaaataaattccttaaataccagtttctggacacagacttctccagagttagcaagtcactgactgcctgtggctaaggctagttttgcatatgggagtagaatattttaaaggttctttttgacttaatgctgcttcaagagaaaacggaaaaaggaaagaaactggcgttttgtgcatcatttatatgccatgtattattctaggcactttgttcgtgcttatgtgtttaatccctaaacatgcaggtatgcaatgtttttctattttattggtaaggacaatgaataagaggataagaacagttgcagctgatggtaaaagtcaggcatgcataaccacggaccacactgctccttgagtggagttggctcagggtaaggggtgatcttagccaggccacccttggtggcatggctcaatccaagttcaaaggcctcagaaccagggaagccaatgatgtgattctcagtctgaggccaaaggcttgagaacccaaggtcattgatttaagttatagggtccaaaggccagggaacctggaatttttgtccaagaacaggaaaggaggagtatatctcagttcaacaaatagatcaacatatttgcattttctctcattttgttctcttcaggatcccagaagatgggatggtgcctgcccatattgaagtcagattttccccatctagtccacttagatgaacatgctaatgtcctctgaaaacatctacacagacataccccaaaataatgctttattaggtttctaggtattccatgttccagtcaagttgacacctaaaattagccatcacacaggggggaaaaattttaaaatatagaaagatgaaaaaccagaatttatcgaattactatgtgctatatgcttaagaaaccttacttgatatcattctcattataaacatacttgatattgcctttatgtagggaggaaattgaagtttataaaggtaaagtagcatacttgcagtcactcattttaaaagtgaccaaaattaaagtcaaatccaaaattaccagactctcagccccttgatttatgctggttctcgcataataccctatgaatcaaatgcactgataatataccatcattgtagctacacctgggtctataaattcacttgtagtctttgtagttttaatttcactcttgatttaaactcagaacctttttttatttttgcatgtccccaggctacatttgactagcttcaagtaaaaaacaaaacaaaacaaaaaacatactgcataaatgttatgtggaaataattcatttttgtgagtgcagtcttatgtttttgtttgttttagtgggcattattctccataatttttataattctttttatttgcagaagcagggtagacagattattatacgcaagtcatgcttattccatttcagtcatgaactgacaattaagtaaaatggaattcttaagagttggcacaaatatttatttgtttccaagttcaactggaaaatttaatgaacttgcaaatgtgggggtggaaaggatgacattttttaagatgatgatatgcctaaacaggtcttaataatacatgttttatcccttcaatttgaatctttccaactttaaaatgtcaacccaagcctgctggggcacatgattgcccctctcgacttactaagaaatgtagacaatgtgatattttttaggtttactttctgttttctattatgccagcccaaataaatgcattaaaaacaaaaataaaccctaagaagagagaaaatgttcgaaaacatttgttcccaacataattccacaggaaaaagtattagaaaacatgaggtcatatcttaagagaggatatagtgcatggtctcagaaaatagaagaaataaaggaaaataggtcctagaatgtgggctctctacatgtaggttttgatccagatttgtttcatcaggcttccatttgcttattaatgataaagtactgcaagtacctttactggtagagaaacaccacaagtccccatggactaatttcagctgaccctggaagcttctgcagcattttgggagcaccccagaaagtcacggtatgaagaattttgtgtacctgagccacccctcagcttgcttttctgtctttgaattgccatcagcaccaaatgaagctagtctagaatataaaaccaggcagcataccagtgtcagcattagagtatgttggttggaacagcacacaaatccaacacagagataaacaatcagaatacctacatatcagttgatcatgctgctcatcctctgaggccagggtacaagtgctttcaccattttccttatggttctttgtgctgtgaaaaggactttgtgagtgcagaatcacagtgaggagaccaaggttggatgaaaagtcccctgttttagcctataactgaataccacaaaatgggtactttattttgaaaaaagaaatttatttggttcatgtttctggaggctgggaagtccaaaagcatagcgccagcatctggtgagggcagttctatggcagaagggggaaggcaagtgagctcaggagacagagagaggaaattgagctgaattcatcctcttatcagaagcccactcttgtgataactaaccccctcctgtgataactaaccccctcctgtgataactagtttactctcatgataacagtattaatcccttcatgagtggagccttcattgcctaatcacctcataaaggccccacttcttagtactgttacaatgactattcaatttccaacacaggaactttgaggaacatattgaaaccatagcagctccaaatggagaagctgggtacagagtttggatgtgggtggggtcagaagcagatggtcaactcacgaaaggaggatgtgtttaagcctaggagtacctgatatcaacatggacagattctaagccttaagaacactctggggtgagaattgatgtaacatgaacaattctgtaaagacagaaatatgcatttgttaattcaagtaacaagtctgaagtgtcaatgatgtgggaattgctgcactaggtgctgaggagataatgatgagccaaatgagtaaattaatgaagaatatggtcccctgaatcagtggagcttactgtgcaaggctttttgatagtgcaaggctctttgaactagtgacatttaatttgagatttaaaaaaaaaaaaaaaaagtggagtggtcctttaaaagacaagcagaaggcgtggagcattggctcgcgcctgtaatcccagcactttggaaggccaaggtgggtggatcacaaggtcaagagatcgagactagcctggccaagattgtgaaacccggtctctactaaaaacacaaaaattagctgggcatggtggcacgcacctgtagtcccagctgctcgggaggctgaggcaggaaaatcgcttgaacccaagacagggatgttgcagtgagctgagaccataccactgcactccaggctggtgacagagcaggactctgcctcaaaaaaaaaaagccagcagaagaataaagcaaacagcatgtttcaagactctaaggactgaaatggtagacataacagaaaaaaaggagagtggttgatatgggtgagcagtgtcatatcaggcaggtctttcagaccatactaagaattttaggtattataagtcaaataggaacctaataacacagtaaaaatagaatatacacacatattcattcatatacatgcatatatatgatttaatttatatattaaaaggtttatattgcctgctacatggagaatggtttatgggagtataatcataaaagaagactaaaagataaaaagctatgtattattttatattctgcatattcgacatattctttgcatattctttgtattcttttgtaccctaggattaatatttttgcagctatagttgacataagataagccacctgtttataatgtatcactagatacatttttgacataagtattcaccagtgaaaccaccactgtaattgagacgattaacatgtctgtaactcccaaaagtttccccacatcaatttgtaatctctcctatcagtccctactcctgtccccaggtatctacatacatgttttatgttattatagtttccattgtctagaattttgaataagtggaattatacaacatgtaccctgtttgctgtctgatttattgcactcagcatatttattctgatattcttccatattgtagtttctatcaatagttcatttctttttactgctgagtactatttcattatatagaaatgtaataatttgattatccatttacctgttgatggatccttgggttatttccagtttggggggctattaaaaataaagtttctatgaacattgggtacccagtgaaattgaactttcaatagttgttggtaatggaatggcgagatcataaagtaggtatatttttaattttctgtgaagctactattggaaatggctatataattttacctttccatcagaagtacatgagagttctagttgttcacatccttttcacatttggtatggtaagtctttaatctcacctattctagcgggggtgccatatatctcattataatttaatttgcaatttaataataatgaacaatgttgggtatctttttaggtacttatttgtcatccagatatctttggggaagtgtctattcaactatgttttgctcacatttaaattggtttgcttatcttattattgagaagtcattcttataaattaaagatacaagtccattgttgaatacatattttgcaattttttcagactgtatcttgccttttgattttcataatggtgtctttgaagagcaaatgttaatgttgatagataaagtccattttattgattttgaaatattttctagtttgtagcttttatattttagttaagaaatctttgccaaatccatggcactaagattttttcctatgttttcttctaattttgtagtttaaactttacatttacatctatcatcctttttgagtgtatatatgtatagagtatgagattaggatccaggttcatttttgtggatatggctatatatactattgatgcaatgtcattttttgaaaatattctttcaccattgaattatgttggcatctttgtcaaaaccaattggccacataagtttcgaatattatatttcagaacgcttttatctgttgcaattatttatttgtctataattaggccaataccatatgccttgattactacagctttataagaaatcttgaaataaagtcatgagattccacaactttgttctcttggctacaggaacgttgttttggctactgtagatcttttgtatttccataaaacatttagaattggcttgtcaacttctgtgacaagaacaacaaaaacaaaaatgcttcctgagattttaatagcattgcaatcaatctgtctatcatcttggggagaattgacatcttaataatatcaagccttctaatccataaacatgttatatctatttatttagatcttcttttaagcttttcaatgtacaagacttgtgtgccttttgttaaattgatctctatgtattttacatgctttgatgctattgtaaatgacatttttgtttcaatttttctttgttgctgtaaaatgatgtacatttatttttgtatctctctcctataaccttgtatcctgaaattttcctaagcttacttgataattatactaggtcttctgtagattccatcagcttttctgtataaattgtcatgttgtttgcaaacaaagacaacttttcttctactttccccagctgaatgatttttattcctattttttcttgttacattaactaaacctctggtacagtgttgaccagaaggtatgagagtggatattcttgctttattcctgatcttagggaaaaaaacattctttcacagctagatatagattttttatagctactctttattaggttgaggaagtgccttctatttctaggttttgagagttttaatcaagaatgaatattaagtttggctatgtttttgcctctgatctagttgttaaattatctgcttagatgtaaaaatggtgaatcacattgattaattttaaaatattaaaccaaccttgcatttttgtgtataaaccttacttagtcatgatgcactatactttttatatattgttgtattttatttcctaaaatttattaagatttttgcatctgtggcaatgagggctatttatctgtaatttttggttaggtcttcgtctttttcggaatcatgataatactggcatcataaaatgaatttgaatcgattgtttttctttaattttcagtgatgagaagcccccgagatgataggaaacaatgaacaccaaaggaattattattttatttaaaaaatagtgcttgctataattgaataatgttctaattttagtatgcatgagaaatacctgaaaattttacttaaatagagatcctggctgggtgtggtggctcacacctgtaatcccagcactttgggaggccgaggcaggcagatcagctgaggtcaggagttcgagaccagtctggccaacacagtgaaacctcatctctactaaaagtacaaaaagtagctaagcatggtggcaggtgcctatagtcctagctacttgggaggctgaagcaggaggatcacgtgaacccaggaggaagaggttgcagtaagctgggatcacgccactgcactccagcctgggtgacagagcaagactctatatcaaaaacaaaaacaaaaccaaaaaaaaaaccaaaaagatcctgatttagaaagaaggaaaccataactagtattaacaaagaaaaacatatctcctcaggtgattttttatgtagatgattcatgttttgagaactcttagtctgctcaaaagttctcaaagtgtgtttctcagaccagtagcatcagaatcacctgggaactttttaaaaatgccgacattctgtactcactccagatctactaaatcagtaactctggggaaagaagtaggtgcagtctgttttttattaggctccaaggtgactccagtgcattacaatttgagaactattgttctatgttaatgacacagagagagaatgtatatagatgcaattaattttgtatatttttagaatatatatgtgttaaatagtgggaaatttcctctaaattggctgcttgtttcttatgacctgtatagaaggtctgagagtgagagagggaaagttgtgtcaggtgtgtgagtagtgtggagacgatatggctgatcattagggaaacaggaaggcaggctgatgacattgttagtgaccattagatgactacttaagctctgtgattgctgttctttattggtgtccatttgcccagtggtacagttttcttcccccattctgagctgcccacagtagaggtatggagaaggcagtttcttggatttgtgtccatttattttgccaaataggtagaagggaagacaaaagggataaagtaaatagagtatttgcaagagagtaaatgactgtagtcatggaccatggtcactgtcctatataaacagaaagatgaagacaagacgaggataattaacagagaaactgctgggttctacggatacaaagtcttgatgagatggaagaattgtttaggtagatacaggttaagaaaggacctaggagtataaatggtagtggctacagagtgaaatgtttgtttttgaattattgtcattttcgtgataagctacaaggtatgaccttggtaatagaggctgagttctactgtgccaaatcattggtattgagaaggacagagactgggtgaataaaatacttacgtgcctattgattttttcttcatgagtgatgtcaatcatagtgatagtaggaagaatgggaggctgacagccaaggactaaatcagaatcagaaaacacaggggcatcagcaccacagaaggtaaattagaaggcatcactgccacaggaaagctcagaagcacctgagtttgtttctctagctgattaatttgggccttaccacaatttcacaggcttatgtccccagtaaatcctaaagtcatagaatgtcttttgatgataaatctgtaatcgcaatatctgagtatgagttctgatgtagccatgcagatacaaataatagcaaccagttatcctgtagaactttgcaaagtaattgaatcataataagttccttgttttttccctatttatgacagaaaccaaaaagttggctttgaaagactcctaccagctcagaagtacatggatgaagatagttgctgatgcaccccgctagcatccattctaattttgtttttcaaattcacagagagtgaagaagtttatcaaaggcaggtgctgtcaatttcatgtatcatctttggaattgtcatcgtgggcatgttctgtgcagcattctacttcaaaagcaagtaagactatttctctcaagtgtttaaaggttacttttagagaaagcgctttgtgttactttaagttctcagtctgtgtgccacacagagggaacctgtggaaatgggtctagcaacaatctgcaagtgacttaggacatttttgtaaattgtggtgagtgtgtacaggcatgtacatgcatgtatgtgatgtgtatgtgcacacatgtgtgcgcggtttatctacgatgcacataatgatcattcctctcagtgaccacgaacattctatgttctttgcactgattcaccacttgctggtattaagggcttggtgtctgcctgtcactaaaggctaactcttctgaacaaaggggccactgctatgaacctgcacattatcaaccattatctatctatttctgaaaaaacaattcagtttttcataaagattttaggcaaatgtggaatatgaatactaaaaaatatacttcagtttaccagttggtatgcacatgttgaatatgccctaaagttaccttgctgagaaactagaccttcttcagataaaggtgtttatgtttgactagaaatagatgtaggccaggtgcagtggctcagcctgtaatcccagcacgttgaggggccgaggcaagtggatcacctgaggtcaggagttcaagaccagcctgaccaatatggtgaaaccccatctctaggaaaaatacaaaaattagttgggcatggtggcgtgccactgtagtcccacctacttgggaggctgagacaggagaattgcttgaacctgggaggtggaagttgcagtgagcccagatcacactgctacactgcagcctcggggacagagttgtctcaaaaaaaaaaaaaaagtagatataaacgtctctctctctctctctctgtgtgtgtgtgtgtgtgtgtgtgtgtgtgtgtgtgtgtgtgtgtgtgtatttttccaaatgaactctggtagacgtatttcatttattaaaatgatataatctgcacttaagaaatgcagataaaaatattagccccttggtttctcatgtcttaagaattttgcacagatttggttcctacagcttgtctgaaattcaagccaatgtgtaattgcttttcagtggacctataattttttaccaatttgctcttctaacatgggattaatttccaggtatagtttgtgatacctgtctgcatgttatctgtgttgattctcaaagaaaactgtgattatgattttttaaaataacagaaacttgagcatcaattcagaattagtaactattatcttcctaataaactatttcagaatgttttttagatatttagaactgttgcaaaaatagaacagacagtttctatataccttagaccaaagttcctccattattaatgccttacattagcatggtacatttgtcacaattaatggaacaatattgatatagtattactaactaaagtctgtattttcagatttccttagtattttacctaaggcccttttgttaatgccagggccccatccttaccatatgatattagctgttacatctcctaggcaactcttggctgtggcagttgtaactatcaatttctgaacacttactctttgccaggcacactgggcttcttatgtgttagcttccaatcaccacagaaatcagagttgtgcattattactgcatttttcaaataataccagaatttattttaaaatgtttatttttcaaagtcataaagaagaaaatgacagataggttctttaattttaggagttctagtttaaatcacatgctctaaacctctataccatactggttcacatagtccttctgctagatggtggagctgcgcagagcgagttaggagttactctcttttgtgcagcccatagcactttatgttctccaagaatgccatctggcataatggtcagggttgtacactagtgagtcatacttggattcaaatcttcaggctgtcatttacttgttatatttgattaggcaaattatatcgtgtctcttagccttggttccctttgtggtaaaatatgaacaagtataatatctaccttatagaattttgttaaggattaaatgcaatcatggccagacgcggtgactcatgcctgtaatcccagcactttgggaggctgaggcaggaagatcacttgagaccagcctggccaacatggtgaaattccatctctactaaaaatacaaaaatgagccaggcatggtggtgagcacctgtaatctcagctactcgggaggctgaggcacaagaatggcttgagcctgggaggtggaggttgcagtgagccaagatcgcacgactgcactccaacctaggcaacagagtgagattcagtctcaaaaaaaaaaaaacaatgcaatcacagtgtaaagggcatagcaaagtgtttaaaagagtaaatacccaatggaggcttgctgtcgttaacacccatggttttccacactagaacttggaggctgggtagctataaagttaagagcctcccctggagcacgagagtggtaatcacacccagcagggtggtagttagaagtgtctccctgctagagctttgtacaagaaagaaattccttacttaacaataaccaaattacaataaagaagcagttaatcacttatttttacagtataatgtgtagttgtaccacatttaaatgaaagacagatcatggtaattatgaaagcaaacagctggattaccaggggacttccatctttggggctgtcaatgtctcactctggacagcaagagggctctgagatcaacatctcctcctgggactcagtgaggagtcaaagtgtttaatgaaaacaatcttcaacatcagattcattagggtaggctcagaggactgcacagaagctagagcaccaagcgggacattgttatctttctgtctaccagcctgggacacagttttatttaaaaaatgaatcaattaataactaaaggcaaaaatgataaaatgatgatacaaatggaagtattttccacctgaaattggattagctatatgttcctcattagaggcctagggtgcatttccttcttctagtaccattttcaggcttggtctcccttttttttctttgcttgagagaaatgccaccaccttaccaagcacctaatttatattgctaaaagcaatatagattgtcataaaaccctggcacaagttgtgtgtgtgtgtgtgtgtgtgtgtgtgtgaattcgtggatttccttttccaaaaccttggggagaacagaatatccaaactctaccttgaccttcccttactttcactcataaaggaaagtagtttatatgcatatacattttttactttagcttagaagccccaagtcttccaggattctaaggcctctctatcactggtattcaaataagttcacttgaacctccattcgatacactgggatgtatagtttctgcccagagggagctgagacttagctcaaagctctcttgatcatttatgttctacttcccataatcacttagaccttgcctttatgattctttttccattccctcgtcacctttggcatggcatgacttcatcagaaggaatattacagcaaattctgtgtctgaggaaagatggaaggtaggtaacatgataaggaataagtaagaaacaccttgaatttagaggattttttgatggagttaactgaacccatagcaactctaaaaaacagtgaaagaaattctcttcactcccaataagctcatatattcctatacatagttaatagaactattaattgagcctgtcaagtctggccagtgtggctcacgcaatgactgtaaattattcaagtttttctctttatttttaacttatgtagttaagaatgatggggatgagtgttagagttcttagcagagcttggaaatacaaaatatgattcaactctaaaactagaattgaagtaggagaggatatgtttcaggaggcagaatctgaaacaggtaattatcacaaatgggaaaaaagaggaggataaaaactggtattatcagtaaaatgtagacacggtaacaacctgcccctaactataggtcatcaaccccttgaagtaagagattttagatcccaaaaaaagcctcttaatggcagacactctgatgcactgctgcgtcttcttcagatatggaggatttagtcgccaagtttgccagcaaacaccggtgaagagtcacctttctcaatctcatgttccattctggtattgtttacctccaatgatgcatcgatatgaggctctgaagacctagaccttttccccaacttcaggtgcaagaccatgccagcttcagagctccctctgaggtttgctgaggttttcactgagactgtatcacattccaacttctccccagcccaattctgcttccatttcttccctttgcttccacaggtgttgataccaagagctctccttaacaaaagtcctctatgctgtctttatcccagggtctgccttcccaggagcccaatctgcaacaagacaaataatgcctaacaatggattaatgatgtctactattctgcaacttacatctcatttctttctaatgcattggaccagagaaatttaaaactcaaatgaactgtaaagtttccacactgacactgttgggctaatagtattcccatgtgcaaggcatgcatcttttcttccccagagcaatgcctctcatgagagagctaatggtattgcaatcagctgctgattgttttctctgttcccattttctgggtgaaggaagaaagagcaaaaaagtgtgtgcttgtgagagaggagggatggtagataggcagaggcaggctcagaatggaaggaccacgtatcttggaatattactaagtcaggacttgagtgaaaaaagactaaaggtaagcaaattataaaaggatttaggaaacgcagtccggtattggatattgcttaaagaaaattcccttataagtttatacttccaagactctgaattggattactgcaaacatcattaagtgtttctaatttaatcccatgagagtaatggaatccttgctctgagacatgcactcttactttttcaggatgatttaccagactagaacctcctgatttccccttttttgtgtgtgcgaatgaacccctgataaaatcttgtggctgtaacatgctccttaaaatgctgatatgatagatttatttttaacaataggctatagattagctgttaggaagcaaatagattattacaacaggattaaagcaactaagagtgctagagataaaagtctcccaaataattggaaagataaaagaaatatcttaaaaaacagagctacatcacactgatattgtaaattcaaaatgggtaatgaagctcaaagcctccaaagcttgcagcaagtgctggtgaattgcttgggaagatgcaactagtgtaatcttttacctttgggtcaatgttctgattcttttgcagcttctgctcacaagactgagcttgcttgatggtatcgggaaagatatgaacattttgcgtgtgcctccacatgcagccaccacagtgtccgtggaagatagcttttatgaacttcatttacagaggaggaaatggaggctcaacaagtttaggaaattattagggtagcaaaactagtgggtagcagagtgggattcaaatcccagtccctgtgatacaataagccacgctctgtagggtgctactgactggagaagctcattgctaagaccggccatgtgctccactgacggcactatctttgtcagagacgttggaagacaggcaaaattcaagggcatgattctactgggaaagttgtcagaatcaaaatggagtcatttgtgttaaaaaccctgacaaatagagccggagaaggacatgaagggagcagtcacgtaggcaaatgcctgattacaagaactatcacaaaagtctgtgaaaaccgcagctttgcatgaagactattgcagccttacatgcacgaaaatagttctgcaaggacatatgcccagcaacttcctgtccacccttggactggcaccatcctttctattgatccttgtagccaaggatagtgatctcaaatcagttgtgtacctaacgtttcctgtcttcctagtgataaaacatagtttcctatatcgtgtgtattcccattgcaacacttatttccaaataaatattttcttttagagtctccatgtttgttatttaggtcaacactgcaaagaggtgtgcgtgtgtgtgtgtgtgtgtgtgtgtgtgtgagtgttgtgtttaatgggtaccaagtctatgctaatagatgatttctgtgaagcttctgggacagagctgctgctaaggcagtggtttgtcccatccttctggtgtaggcactgagtgacccagacaacagtcattccgcatgtgcacacaggagcactttacttgaagtccagaaccctacagcagtttcagccttttcactcagaagcggtgggaccatgagcacatggcttggcaattctgagtggtggttgaagagtgtaaactatggaggcaggttggctgggctgagatccaatcgctgccactcactgactatgtgacgtcaaacaaatggcttagcttctctgtgctttagttctcatctacttaatgggtatagcattatggcctcatcacaaagaattatcatgaaaaatctgtgaaatgatacatataaagcacttaaaaccatgtgtggcacattactgtataactagctctttaagagttaactatttttaatatctgggctcttggtaacaataaatgagctatttctaaattgtaaaagacagagaatatacacattatggtatatagtcaagttgtgcaattaagctaaacatatttgaattgtacaaatataaatgtaactctacaaatatgtcatatgtacctgctaagcccaagtcttaattgttttcctctagtcactttcccatagtatttccagttctttgcagctaaaactcagggttagagacttcttgcatctatgggggccagggcaatgcactaaatgtttgtctgcttttggggtgccactgaatgtgaattcctagagaatatggatgatatcaggttatcactaaactggaagtatttctggtggggttggaaatgagagaagggttctcttcgttagctgagtttatttaactttagcaaataacaaatatagacactgggaatgaatgagaccctgaaagtaggagttgaataaagtcatgcaaatatttgtacacgtttatttatgcctgcaggaaacaagctaaacaaatccaagagcagctgaaagtgccacaaaatggtaaaagctacagtctcaaagcatccagcacaatggcaaagtcagagaacttggtgaagagccatgtccagctgcaaaatgtaagtgacatgtctacacacctcctcctatagcctacctcagtgcttccagctcagaggtgttgggagcctgggatcagacttgtaaatatttttcagagctttatagggttttgcttaaatcgttttaacagttctgggctgggacgtatgcacacatgcatgtatgtatgcatcagataaaaggcaagttaaatttcagctcttgattacaatctgtaatataaactaatctctagtaaaaataagagcttcagttttttgtcccatgaacacttgttgaatccttagtttgtgccagaagttgtatgtgacaccaaggatacaatgtcccttgccataagggaagttctatgtaggaagaaacacaaaaacccccagaatcagaagaagtgagttccgagatagttgttgttgcagcagaggttggacaagaggaagccagtgggaggtggatgggggtagacttgggggctgcctcacaacagagtcggactcggactgggtttggaaggatatgaaaagttctatagagagtcaaagggctaagagctagaagccagaacatgcaggaagaataaagccatggaatcctaaaaatgcatgttatgttcagagaactccaagttaaggggtgtgagaagaatcaaaggtgaaaggtggagtttcataatcaatccttctaattccaagccttacagagatatcagaacttgaagttaaatgcaaactctttgcctcttacactttttgtaaggcagttttaaccattactgaggtatattgcaaaacactaaattaaagcaagagaattctgtgtaatacatgcagatatattcctcttaggttagcaattctttgaccccacacagcatccgcactttcagaatctgaggcataaaacaaaagaacaaaggccattgcataaacctagcatttgagtataataggcaatcatccaggacacattcacacccctccaaatgcttcaatcactggaaatttatacatcactggtgattctaagaaatcattacccaaaaagtcgctattatgatgtccataacagatgtactcagatgatttaatgcagaattcataaatcagagtctcttcccaggcaagttttgttaaacttctattcatggcaatgtgcaggaattgttcatttcagaaacagagtgaatggttttgctattgatttctaatgggtataatcccaccactctaaaacaaccacagtgatggagggcttcattccttagcaactggttatgtcaaagataaacaaagccagacactagttaaagtgatgaggatagattctaatcagtaacatgttagtggaatagttgaactgaacttctatttgtacggaaatggctggatttttttttttttttttttgagaaagaaagaagtaaaattatatttgtttgtaaatgacatgatcttctgtgtagaaaatgtcaggcttctgagcccaagctaagccatcatatcccctgtgacctgcacgtgcacatccagatggccggttcctgccttttctgatgacattccaccacaaatgaagtgaaaatggcctgttcctgccttaactgatgacattctaccacaaaagaagtgaaaatggccggtccttgccttaactggtgacattaccttgtgaaattccttctcctggctcatcctggctcaaaaagctcccccactgagcaccttgtgacccccacccctgcccaccagagaacaacctgctttgactgtaattttcctttacctacccaaactttataaaacggccccacccctatctcccttcactaactctctttttggactcagaccgcctgcacccaggtgaaataaacagccttgttgctcacacaaagcctgtttggtggtctcttcacacagacgcaagtgaaagaaaatcccaagagtcaaccaaaatactgctggaattaataaacacattcagtggatttgcagaatacaatatcagcaccaaaagttagttgaatttccatacattaacaataaacaattttaaaagaaaattaagaaaacacttccatttgctagagaacttaatgtaagaaacgcttaggtataaacgtaataaggtgaaaagtttgtaccttgaaatctacaaacattgatcaaaatgattaaaatcaatagacatacaacccatattgatggattggaaaaattaatattgttaaatgatgatataacccaaaatgtggtttaaattcaacacaatacccataaaaatctctatcagtttttgttaaagaaacaaattaatataaatgcattgtctcatttagttctaacaattaatttatacccacaatgtgcagaaaatagaaatgggatttggagcttgagaaaggtatgtctgtcagacagctagtaagtagctgaaagacaaaccaacatccttataactcagtggttctcaacagaaggcaatttgcccaccatcccttgacatttggcaaagtctgaagacactttggctattgcatgctgggagaagaatgctacaggcatctagtgggtagcggtcattggcgctgatgaacatccttcaatgcacaataacctccctcaacagaagattatccttcccaaaatgtcaaaagtggtaaagaagttcacagtccatgctcaagtttcaaatgggaccatggggaagttctgaacaccaagttccatcaccaagcttcccaccgcaggcatttatttccactttacagagggtgacgggttattcaggcatatttcatccttggaaaggaaaatttcctacttgcttaccatatcaggcaaatctgtctttgttttatcttgaagctcatgttaactacttgaaattctttgcaaattgcagtgtttaacaaatgaattgtctggctctggcattcctttattaagttcattaaacattcatggaaatgggtttcactttatagtcatctaacaagatgcaaaacacctcgtcaagtgaagcaacatgatactctggaaacacttgactccaaggctgcagaactggagtagattaccctccctgagaagcatctagtccctaccattgttttaaaaacaaataaagcatctgtgagtaaagatgaactcacctcctttgctgtgtctcaagtaagaaagagctaaggatagaattataacctctagaaccttcaaggcaaaggagtgaaacttctcagcctggtttagggatcagaaaagaaagtcatcaaaagagatcatccgttcttctctcttaaaatcaagagaaaatattcacaattgaaaaatgaaagaagaaaattgtatacccttcataccttttttttcagtaatcattttaagaaaggtaagtttatgggggaggtaacattaaatgagaaagaactggaagataatacttgcatgctaaagaggaataataagaatttaatgcctaggccaggcgcagtggctcacgcctgtaatcccagcactttgggaggccaaagcaggtggatcacctgaggtcgggagttcaagaccaccctggccaacatggtgaaaccccatctctactgaaaatacagaaattagccaggcgtggtggtgggtgcctgtaattccagctactcgggaggttgaggtgggagaattgcttgaacccgggaggcagaggttgcagtgacccgataccatgccactgcactccagcctgggcgacagagtgagactcagcctcaaaacaaacaaacaaaaaaaacaaaaccaaaaaagaatttagtgcctaacagagccttaaaaattggtgaaaaggcacatatttatccagtaatgtttattgaactctggtaaagcccacacttctctgtgttgggtactgcagggatagcttagaatacaaacagaagaagtggttcctgatctcaggatgttcaaaggttagtggagagaaaaatgtacaagcatataatatctttattatatagatacattaaatcaaagtactatcagagaatggaaaacgacttctgaatttgactaggggaatctcaagcctacctaaaggaggtcacatgtgaattgagttgttggcctaaaggaaaacaaacaaaggaaacaaaaaacctaggcaaacttaatataaatagagcaattattttggccagttttgaggactgcaacctgagagcatagacttaatgtaccctaaatacatgctcccatcagcagcagttacaagtgggtttttataggaaatgaagaggcagttcccaaattgtttatcaagaatttgcattaggccgggcgcggtggctcacgcctgtaatcccagcactttgggaggccgaggcgggtggatcacgaggtcaggagatcgagacaatcctggctaacacggtgaaaccccgtctctactaaaagttcaaaatattagcctggcgcggtggctgacgcctgtagtcccagctacttgggaggctgaggcgggagaattacgtgaacccaggaggcagagcttgcagtgagccgagatggctccactgcactccagcctgggtgacagagcgagacaacgtctcaaaaaaaaataaaaaagaatttgcgttaaaatagtataagctattgcttggcttatccatggttctttttattacaaattccaaaaacttgaaaataagtgatgaggcagttaggaacaaaatgtctttaaacaatcacccctgggtttggtgggggtgagtgactacaatcccacactctgtctctctgggcctgataaattttgcatacctcatatagctcacactgctctgagctatttttggtagagttttgagagtgaattgaaaatcatggaattgtttgcagggagtaggtcagaagaggtaattttgttgtagcattaattaaagttaatttttaatagttctagcctaaacgctgatttattgctttaaatatcaaattataacttattgattgaatatagattcatacattcatttatttacttaaatatagactaaagagcctactaagtaccagacaatacctattaaggaacaggcatgtgatgatgacaaaaaatgagaaagctgcttctttcaagaagtttgctgattactgcgagtgatcaatataaatcaaataatctcacaaatgtgggctctcatctgtgccaaggcctacaggaaatagtgaacggtgctatcagagcttatagtaggcaggctggggagttcatatcagaccaagaatagctcagctctctaaaaaggtgcagttaacacatgaagaatccccctggtgaagtggtaatttgctggggaggaggtggcgttttgtgctgtgcctagtgtctgaagagggtctcttttcatattattttgctttaaaggaaatgtgtgaaaattgcaattcttaaagttcttgctgctttggtgtccatgcaaaaattctcaacagcggtcgagttgtttttaattacctacattagaaatcccagtgaaatcactcttgaaaacatattgtaactatcaatttccccatactcgggctcataagtcagagtggcaataaagaaaattttgtcacagacatatttgaaccaagcaatgcagagagaaagacatttaaaactgcctaaaaatatcctcctcctgcttttattgcctagggttccagaccaggcgattatcagcactgtcaacattgctgtccaaaactgaccctactttcatttaaccttctgactcctgctgtgtgcatgtggcagacctggaaacaatgctgttattctactgccaacatgcgcctgcttcatttgactggcctattgatttcggtgcaccacctacaatgtgctaggagcaaagcaggtgggcgggcaagaggagataccttcattacctgggagcatttgcattagccggcactttcaggggggccagttggatgaatgcttctcctaggaaataacaatattaaccagggcctatgaaggagttaacaacaacaacaaaaaacacttgagctaatgctgagagcaccattgaatgaactggggcatctccttattcactgctaacaggatcttttgtatattataccaaatgagctcttaaccatgtgcacacaataaagtcaggatctgtgtcaaggaaataacatagaatcaactgccaggctttgtaacattgtagaggatgctaatagggagatccagacaggcagctaatctgagcacttaaatttcactgaagatacaatcttaagaataagtttgtccagaccttagcttgtctcggagatagaactgcatgcatttggatggaaacaaaataaatatttttgggctgggcactgtggttcacacgtatgatcccagcactttggaaggcaaaggcagatggaccacttgaagtcaagagtttgagaccagcctgcccaacatggtgaaaccttgaccctactaaaaatccaaaaattagccgggcgtggtggtgggcgcctgtaatcccacctactcaggaggctgacacatgagaattgcttgaacctaggaggccgaggttgcagtgagccgagatcaagacactgcactccagcctgggcaacagagtaagactctgtctctctctctttatatatatatatattagcacagagcataaaatgtccaaaagctatgatcatggtcagtcaggctaactttccaggagggttggtataggtgaactgttttgctgagtggagtatgcatcttgagggcctacacctgagctactcaagcaattaagggaagactgaattctgcctttagtctctcaattctttttgtttatttcgatgtgtacttttttaatcatttatgttattttctattttcttaagcagatctgatattttaggatagctttcaatttacagaaaagttgagaggataccacagcaagtttctatactctgtattcagtttcccctattattaaccttgtatattagtagggcacaattctgaaactaacaaactaataagaatgcattattatccataaaatcccacatgttggcattctcacaattgctattgtttattctgattttttgagtgttcacctgattgctgcctgtgttctaatcccaggtaccgcattacatctaatattcatgtctccttaggttccccttacctgtgacagtttgttgattttttctttttatgatgaccatgacagttttgatcagtactggtaaagaattttggaggatgcccctttattggaatttgattcttttcttatgattacatggggtttactggttttctgtagaaatttttaaagtgccatttttattatgtcatatcaagatacacgctacaatatgatttattattattgaagtttaccttatcatctgtctgaggtaatatttgccaagcttctccactgtaaagttacccttttcttctctctccttttgcatagaatactctttggaaggaagtgattatgcatagcccactcttaaggagtggggagttacggtcttctttccttatggttaagtatctacataagttatttgggattctatcacaaaggggttgtctcttctctcccatttacttatttattccatcatatatttttatcagtataaataaactcatggatactattttatactttgatttgtaatctaagtagtaaatactatgttacgttctcatcagttttttctggctttggccattgataggtctttcagctggcttatgtcattttaacattatgtatcaattcactgtaagttttcagggtttttttttgttgttgagcactacaagacactccttgcttatgttgtacattttctgccttggttctagaatcagccatttctccatggaaatagctagtttctttctttgcagaatttcattggagactgagatttggaagctaggtgtgtatgttattgttgctacagggatgtcttttcttggccttctcaacagacagatcaaagattttatatatatatatatgtatatttttaaataatagatatattaaatatgtctacttaagacatatttaaataatacatatattaaaagatatatttatatattgaaggttgcatatagactaacacatatctaaatttttctatgtaagcatctgtatctgtattctgctaaacatgtgtctacattgatgtctacccccaaatctaatccataactacatcaataattctaccctcctcccgttgcttatttataaatttccactccaacagtgaaaaacctccttcccactgtctattattcatttacttattttttcagtgacagaatacacataaagcattctcacaatggttataccatacctttgcactgttcaactttaatggctaggcggtgcatttgggcggtagttttgcctttagtctgctgaacacttgtgaccttcagaagtgtttcttcactttttttcctctcttacgtgagacggaaaggctacagggagcaggaattggggaagtgccttctttctggtgagataaggctctggtaaaatatttttactacaggagtaggcaattgttattgagaatgctctgtgtgcatttcaaaatagttacttttccccttccactggcagagacattagatgattttttttgttgctgttggggttctttgctgtgagaacctggtgtggttcctggaggtcaaacccatggaagtatcggcattctgcctaagactacagaccccaactctcgttctagtgcccatacagattccagcaacttgtccaaattacttcttaaacattcctaccaatttatggttccagcagattcagttgcagaaaagctgatcttagccattattctctgtattcacctgtttctccagatttaaggtggcagtgtgcccttcaacctcaattatccaatgaatacaagaagacattttcagtttgttcatttatttttcttattgctaggacaggaatagcgacttccaaactcttagcttgtcaaaactgaaaccacagaagctatctgaattcatgttcaacaaaaatgtatggaatataatttggaagttggtcaaattattagactcttatcatgcttccacaagtttcaagcaacctccggataggaataccagcaatttaaacttgaatttcaggtacaagtagtcactgaaacaaaatgctgtgagagaaagaaaaaaagttctaaaataataaattctggaaacacatttatattaatggaccaaaataatacaaataaaaacaactgtttaatatcgcaataattcaaacatatgaaataacagatttaggaaatatctatcatgaacactatgaataaacagaacaggttaagaggttaattctgtttatgagtgttatccggaattttggacaaggccctctatctctcagattctaagcagagactatgaactaatggtacaaaagatgaattaggctttttgacaaggaaggaagggaggaagggaggcagggagggagggaggcagggagggaggaagggaattactgacttttagtgatttggcagtttctctaaaagatctgcatgctccagaaatagttggctgatattgtcccctggcagcccgtattagtccattttcacacgctgataaagacctacccaagactggatgatttatgaagaaaaagaggtttaatggactcacagtttcatatggctggtgaggcctcataatcatggtggaaggtggaaagcacgtcttacgtggcagcagacacaagagaagagagagccaagtgaaaggttttcccttataaaactatcagatctcatgagacttattcactaccatgagaacagtatggaggaaactgccgccatgattcaattatctcccaccaggtccctcccacaacacgtgggagttatgggagctacaattcaagatgcaatttgggtggggacacagccaaaccatatcacagctctctgcagttgctgaacatacttgctttcttcagtttgtcatggatttgcccagagcatctcacttgtttttgtagctgggccttctaggcacctaggtttttcttgtaaaccagtttattagataaaaaaagatatgtcttttatatccctcatatgtcttttatagacctgaaagtcagacagatattcaggatatcatcgcactttaataaacatgtccattcatctgactttttccatgggtactttgcaatacacaatcaataatgaagcacacatagaggtatttccattatgtattggatctttgttatttgaggttgttgaaaacaatcaccttttccaaattatctctgtaccttctctttgttctctgtcattttcctccattttgcaaaaagactgaccagcctttataggtccactgtgaaaaattcggattctggttcaagacatggtcattactgccactatgtggcttgttttggaagttattgaaaataaaacatttaattggagcttttgaacttaaagctgcaaaaccttgatatgttccctagtctccatagcttatactcatggatatactttttcccaagcataacacctaattagatagttaataatttcttttaacttaaaaatctgcctcctaagtaattgcgtgagaaacacacacatgcaaatgcacacagaaaaatatatgtacatacaaaatctgtatatatataaacaccaggctaattatgtgtatataaacataaatatatacacaatctatttatatctattaattgcaccttccttatttacacaaatggatttatatgcatacgcttttgcgccttttattcttttcaatggctgtgtagtattcatttatggacatttctattgttttgagtttttttcacttttgtgtttatttccgtttcgttatggacaattgtgctgctgatgtaccctggaaattattattttgaacttttgcaattatggaaatttgcatgatagaaattctaaaagtaatattttggatcaaagagtatgtatatctaaaattttgaaacatattgtcaatttgctcttcaagttagcaccacggctacttttccagggccttttcctttatcagatattcttgaaatttaaatttctctatttattttaaaggcagagtcttgttatgttgcccagcctggagtgcaatagctaatcacatagcacactacagtctctaactcctgggctcaaatgaccctcccacctccacttcccaagtagctgggactacagctgtgcaccactgcacttagcttaatttcctctattctgattaccacctctttataatgagtgcagttgcactctttgccatatgtatgttgcctgtctttatttttctgtgaaattcttgttcacctgttgcctttcatttttttccagttgatttctgcctttatatcttaagaatagtctttaacataagaatagcctatgtttccccaggcttttacttatattttgatttactaataatcatttttgttacttaagacatttaaattagtagtaaatcaaattttacatatttttttctttatggtctctaggtgttttgtcctggtaacaaatgtctttctcccataaggttaggaatacatctcccatatagttttataaaggtttttgaatgtatttccattatccaaagagttcattcatatcttcttgtgttagtctgtttgccttgttataaagcaatgctgaggctggttaatttataaagaggtttatttggctcacagttctgtaggctgtacaagaagcatggtgccaacatctgcttctggtgagcatttcaggaggcttctgctcatggcggaagggaaaggggagcaggtgtcacatggtgagagagaaaaaagagaaaggcgaagggtgccatgctcttttaaataactagttcttccatgaattaatagaatgagaactcactcattactgcagggaggatacaaaccattcatgaagaatcaacccccatgacccagacacctcccaccaggcctcatctccaaaattggggatgaaatttcaacacgagattcaaaggggacaaatatccaaactatatcacttctctttatcaaaatctaaaaatataaattgaactaaaattatactttactgttatccatagttatgttccttgccacaattcataggtaattaagttatgacaatgttaatggtttataattttcgtgactagttgagaaagccgttcttttttttttttttttttgatacagagttttactctcttacccaggctggagtacagtggcaccatctcggctcactgcaacctcaatctcccgggttcaagctattctcctgcctcagcctcctgagtagctgggattacaggcgcatgccaccatgcccagctaatttttgtacttttagtagagacagggtttcaccatgtttgccaggctggtctcaaacttctgacctcaggtgatctgcctgcctcagcttcccaaaattctgggattacagtcgtgagccaccgtgcctagcctgagaaagcctttcatagtgaagctttgttgttaggtagataaaaatttatgaatatttatcacttggtagattgctcattctatgaatatgaaatatccatctttcttccttttaaaatgcattttatacataattatattttatttgaaattattactgttaaaagctttttcacctgtacattgcagggtatatctttaccaattctgtcgacttttttctctgttgtttttaaattagctctttcagaacatagaagaccagatattcagtgtatgaatctgtcttttaatagttaaatctaaccatccacagtttttatcatcactgatagtttcacacttattcctgtcacatttatttccaatttaccatgctctcttgttacaaacccccttattaatttttgttgaattaatattagtttagttttttcatgtattgtatattacacaattcttatattctagtgctgtctaatttctaatacttaaatatatatattttgttcatcagtgtctaaaattaatcagcatgcatatattacattgtctttattctcaacaatcccagctaggattttttgtttttaaatgttcattcttctctctttttatgttctttttcttatcaatatcttccagccatgttgaaattctttggactttactttcaagcattaattttaaagccgacattttaagaaagagcttacaataaaatatcttccactccttcctcctggattcatttttcttcggttagaactatttctttctccatttcttacttcataagtcatctttagaatctatgtaaatataagactacaagcagccactaccaattgattagaaatggtacttagggtggaatttatctttagttttttatagttcagagataacatttctaaaaggctaggaaacatcttagagtatcatcttaattattgtatctaccttctttttacctggatcaagtgcattaagtattgtctgtgaattttttcaacaaccctataagagagattttattatctcaccatatagatgtgagattcaaaaaggttgattaacttgattttttttatcagtgcttctaatactggcttctttgcttttgaaatgagaaaaaaaaaggtatactgagttttagagttttacagttactcaggttaacacttaaaatctgtagcttgacacattgggtactgaatatccagattcaaaactctcttttattttgattagcatccttaaacttctatttctaaagaaagtcttcacctggagtttctagaagagaactcttctaccttttgccacctgttccagcgcccagtgtgcagggagtgttaaagttgacaacttattggctcttgagatgccatgtgatatttcttttggggtaaaatttttctgaagttgtcatctacataagccttctttaggcttctatatcttataagctattatagtcaaaggagaaaccaagagttctgaactataaggagtgaaatgctcacaaattctcttgttaaacatggtaactacctggtaacaagctgaaagagaaaaacagtggaatgtggtggccagatattctgaaccaatgtctttcatcattctcagaatgttatgaaatttaataagtgttgattcaatccttattattagtaacccagctagtaattcaatttttttggtaagatgtacatcaactaaaacatacttgtaagtgccttttggctgtcagtcatagtgtgccatgggtgtgcattaattaaaatgagatagcaggcttgggatgctgacatgaagaaccctcttcaatggatcctgactaggcacagagatggttggggcaggggaggtgaatactcaatgtattggaaacaggacacaaattatgtcttatctcctgctcctctagtcaggtgaccaggaggaactggcattccagtaacttctcaatgcttagctctggtgttataggccctccataatgtatccttcgtctcaactctgtacgtgtgatttcccacagtattcaaaggtggaaaggcatcctgtgactgcattggagaaaatgatggagtcaagttttgtcggcccccagtcattccctgaggtcccttctcctgacagaggaagccagtctgtcaaacaccacaggtacaagtagctcatcatggtgggtgtgggcaccttcacactgtgtgtatgctgggtggcacatgccaaggactggcagcatgacttaggagagacaactgttcttgcttctcctgtagttctctgtggagtaaatgctcaaacacctcacatcaggtaaagcaaagataccagtttccacagcagacagcattgcctctgtaagaaacctgatagaactatagataacacccatcaaagttacagaccagtaaaaaaaaaaaatgcattctgaaaaactattttaaaaaatatgttatctagcctgccttttctagattacacagttaatgagtaattcttccctatgcagcctaatgtgacagacttcaggttttccaatatggttcttacaaaataaaattttccacggggaagaagcctggtgaatcttcttcttgggtctataaaatcttctgttataaatgaggtggcagtttcttgcaagcttcccagaaattggctgctttggagaaaaagccaaaaacatagttatttgacacatttcatagcattctaaagcttaacttgtccttcagcatcttctagtccacacttttctgttatcaggattctgaaactccaaatattaaaggtatttgttctaaaccaaatgatgaagtttatgactaatgctagattgtgttcagatatacatcctcaatctttatggaagttgtccgaagacttaagcttccttttcttagtgaaatgtacaatattttacaatttgaaaaaattatgaaaaattaaacattttaacaatgaaaaagtaaataacagttgttcccagcaatgaaagttgaatgttgttgcccctttgttttcacatgctgggcaatagtttgcacaacaccaagccagaaacatacatgatagaagaaaactactttctccttcaccttttaatgagttacatgaagaggattttattgtttctggccacacttactttgagatttttagtcactcttgacactaatcctcagcacttcatggtaatttttattctcattctacatgagtagagactagaacactgagagtttgccatttaaaagaatatggtatgagtctatgttcaattcaggattgaaatatgtttggctcttggataattgctttagctattcttactgcaagttttgatttatatcaatgttgcatttacagaatattttcctgtgaaaagagcatttcatttcactggacctaatggaagttttcttaattagggaaataagtccaatattaccagtcttttcgaagacagatattttctcccaaatggtattttctcctcctgattatgacacgttaaagtagtattccacctagtcaagtaattcagtataatatcattctagtattatatgaactgtattctgtcataaatgttttaaaattgatatatatgttttaaaacatcagctcttaatatgtttgagctgcaatattcctatccccagttctcgtgtgcttttatgctccctcctaaacttggcttctcctatggtgtctaggagtcactcacagattaaataaggacatctttaagagaccttcctttttgtttggatcaatgacattgcagtatctgttggcatacactgtgtcctgatagatgggcaagcgttgacttacaaaatgcttttagaactttgtaaattatagtttaatatatcatagcttttgttttgtaaaacatgcaatagacttgaacgttttcatgatcgataacccaggcactgatttatatatcctgcaaactgcaccataacttcctgaatgccactgagttagaaggcctgaatagctgattgatcaataggcataaaactctttttaagacaggtcactagttcatactgatatactttgttgttatgacagtttagcgaactatgaataattaatttcttttgtgcactgcaaatatgactcatttggataactcatatatgaaacagagctattaattcaaagccattatttctaatgtttagttcgaaaaaatcccatctgtttagaaaataaatctattacggcatgtcatatttattgcattatattttggcaatataagtcacttatctttttttattattttatttttttggagatagagtctcgctctgtcacccaggctggagtgcagtggtgtgatcttggctcactgcaacctccagctcctgagttcaagggattctcttgcctcagccgtctgagtagctgggactacaggcacatgctaccatgccgggctaatttttatatttttagtagagacggggtttcaccatgttggccaggctggtcttgaagtcctgacctcaggtgatccgcccgcctcagcctccgaaagtgctgggattacaggtgtgagccactgtgccccaccatgccacttataaaaagcatgtatgtaggttttttgcattgaaataattccagggttttcagtgacagagaggaccctttgaattgccagctgtggcaggggagatagaggaactcatcgtgctgagcacctattgtgtgccaggctccatgccccatgctttgcatacttcctctctttaaacctccacatcccatagtgaacctaggaaaattcttaagtagaatgctgatatcttccttttgtcactcccttctcactctagcagctagtttctaccttttttgttttctgccttgccctgtacaccaagagggctgcaggctcttatgtcctctggtttctgtgggttcagtgtaaggcacaggcatgagatagacggcagggaggacagtgaggtcatggcacttgtgtccccttcctccctgcttggttgccttccttatatcccttttctggggccatggagcctgcagtgcggccccctccttacaactcactttctctctgcattctgggaactgctccctctccttgtcccttaagtcagagggataataacagcttcccatagtagtcctggggcacagcagtctcatttattgctttttttgccctcgaacacttatcacacttttgtatatagcaaaatctctaacaatgaaccaggttaaagtgccatctatgtctctccaggactctgactggtacaagtacctccatcagcatcatgcttccagtaactagttacctgcagacctgagacttatactcagttgcagccaactctagcatccaaggcttcaggccccgcagaccccatcattgccattggatggtagataaaagtaggaaggcaaggaagcaaattagctgttagagagcttctccaacttgtgggcttagtgagctatctagacatcccttgttaggcatttggggacacaccatataatgaatgaaggtataggggctaggcacagtggctcaaacctgtaatcccagcactttgggaggcctaggtgggtggatcacctgaggtcaggagtttgagaccagcctggccaacatggtgaaacctcatctctactaaaaatacaaaaattagcctgccattgtggggggcacctgtagtcccagctacttgggaggctggggcaggcgaatcacttgaacctgggaggtagaggttgcagtgagccaagatcgtgccactgcacttcagcctgggtgactctgtctcaaaaaaaaaaaaaaaaaaaggaatgaaaggaatgaaggtataacaatgaatgttgccagatatgatctcctgcttgcacacatttaggaagttaatgttggcttgaggaatataaagtttgatcagtcaccgtgccacaaccaagaaagtggttactaacactcaaataccagattttcaaactctaaccttaaataatatttgtaaagtcctgttttgtattgactaagtagaattaacagtaatatttatggaagaaaagtgacataaccccaaataatatagtaatatgggtaaaatgtctttgagagactggtttctttagaaccttgataaatttattgaaattttgagaatgttttcatctttctttctatggttgtattgatatttacagagttaaatgagaatggagcacagaattctcagttcctttattatttgagcactgcagaaccagtgtgaccacataaactagcatctcgtggaatgtctacacatgagcaaagttctcctcaccagtctacagtagggtcaattcagtggggtggagatgggaatggatatggaacaggtaatgagtctcatcagcaatggatttttatagagtctagttcttttctgtgcataatctatgtaggaattctcagtttgttaaggcctgtggtataacccacttacatgttttgctcattgatggcatctataaacatatagttatttaggcatttggatgtatgagtcaaataaaatatataatcagatgtttattaaaagcaaactcagaagaaaaataatttagtttgtcaagattgattaaaatctgaggtcgtgaacagggaatttaacacatatgttaatgagaaaatgccaattaaaagttgttaattttatcgctaataagtgaattttttccccatatcccttctgggcttactgtgttcagtttttgtcagcgtctcataagaaggctatttttatttctattagagagacagctatgatggcttggataatcaggatggatgggaatgaggagcttgagaattccttaagttcacctcttaccttggctggaaagttgcaatgattttcatcagtcatgctctaacctagaaagccagaaatccaggaacttccctttttctcagtgtctccaaaggtaaaatggattgggctattcctgatctcattctaccacatatacttcattcagggatggccctggcctagaactttgagaatttggggtgcagattcagtgtttgcaaagcttgagcagccacctgtgaggttattgctatgatgtcttttgtttgtttgtttgtctgttttcattccaccccagcaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtaggtcttaaaacagcagtggaatttagggagggtgtctttaatgccatagctttaagttaagttttaagttccttggggttttattcattgatttattcattaactggctatatatgcttactgccatctttgttctacaaaaggtgaaccaactttgatgtatagttgtgatggaaaataggtatcagggaaacattagattagaaagaaatataactaggaagaaagtaagtgtagctctctaggcaatatgttattagatcatttgctaatacaactggaaatttgtctttgatttaaaaaatcaaaggaggattaaagtgttccttcatctgcagattagaaaaaggaccgaattctctgataagtattgtgaacaatacgctaaacaataactcatggcatacgtacagtatctgcttcccctgagcttgaatgtagaatttgggtcaatgttgagagtgtaaagtcaaagtacaacttactgaactcatatatgcaagttaggggtagacgggtgggctttggacaccattgctgctactctttacagtgcaaaaggtgtcccttcctctggtggacacagatccatagaggcctcaaagcatggtgagctgagtacaggatgaatgttaaccattatccatgtagttggcataaactgcccaactaaacatgcgatccttgcttaaactgactggaattcaaatcccatctctgctccttactactagtgtgactgtgataatattttatgatgtggtcttagatgctcttatctataaattgagaaaaatagaccagacgcactgcctcacacccatagtcccagcactttgggaggctgaggcatgcagatcacttgagctcaggagtttgagaccagcctgggcaacatggcaaaaccccatctctaacaaaaatacaaaaaattagctgggcatggtagtgtgtgcctgtggtcccagctgcttgggaggctgaggtggcaggatcctttgagcctcagaggtggaggctatactgagtgcacatggtgctactggactccaacctgggtgacagagtgagaccctatctcaaaaaagaaaaaaaaaaatacaaataattgagtaaaataatatcaaccccctgaagattgttgggcagatttttaaaaattatgtgtgtaaagagtttgtagtagacacacagtaagcagagaagtggtactggtatttattgtcacagtaattgttataattttttcagcaatttcaagtgcaatgcaatcagggtttactctagaaatttcagaaatcacttccctcactcaagccaggttcttgtggctctgtttttatctctctgaacgagccaagccaggtttctatgctgctttggcctggatgatttttccagactgtctctatcaggctaaagatcaaaacgggttacgtctagcacagagcctcacgtttctcttttcatatgggcatgggatatatggagcagtgtcctgtctaacaaagatcagcaacagatttcttaaggaaaactggaagataggaaataaatggccggtggctaggttttataattttgaagcaattccaaatggactgtaaaaggcatttggtacagatttagggtgacagttgcaaagtaaacataacagccaaggggttcaaaatgtataatgcgagtcaagaagcagtttgcatttctcttggtcttatctgtggaaaagcaggcttgcatttaacccataattataattgatcatgtttcatagtgccttttccatataaataactaatgatgcctcttattagtgaatatgactatatacatatacataaactccctgggatgaatgttacaagaacaagtgagggaaaatcaacttcagagattttgtgagtggacaaaaaacccagctcatgctggccttttttttctattgggcactgttatgaccatctttccatatgttcgattagtaagggtgcttggagcctgtgccaggctcaagcttgaacaatgcacatatcatcaggggctcagagatctcattacatgttcaggcaatgctttgcttttttaacctcctgggagactcacttattttctgcgtggtggtggttttgttttggttcagtcactgttgggttggaatattctctccagttgcctggccacaggtattttcccatgtgtgatatccaccagatgttgataaatggtgactctaaatataagtcactgtatacccagcacaatgaatctcagggagcaatctcattctcagttcttaaaaacagccattttccactccctggggactgactgtctctctggactggaaatgggattcgtaatagaatttcacagctaaaggccgtctttaaatctggccccagcctggaggagggggaaatgaatttgcaagagccatcagccatctgctccttgtttaccaagcaagtgggcgctgtctatgacagttaggcttccaacgtatgtggcttctttccttggcaagaacttcagcccagcttgaacctaacatcgatcttattgtagcctggggaaggagtgaggtggagaggagattcttgaggaaactttgtcatgactggatccctggtcaatgacagccatggtaatggctcacagaatttgaactgtatcatgtcaggaaaatcaagctaatgtattcatatgccagacaaaaagagatggaatcacaaaagttagattcacaccttaaaagcagataaaattcaaaatgtactgaatacctaccacacctagctagcaactttatatacttctcttcagttattctttagaaattttattgataagcacattaaggatatcagagtttaaatggctagcccaaagtgacatacacagtcctgtgtaaaagagctgcgattgaatactggcttttctgactaaataaaccactaaatcaacaaggaatgtgaagaaaaatcacatttatggctgatgatttgtaaacggaatatctaattttatggcttcagagggaagcgtggatgccttcaaaatagtctgttcattcattttcatgtgccctaggaactgagatggtttggagtcgcctagagaaacacaaattccttagcctgactcatgaatgactgggaaccaaaccaagtgactaatagttggaatctttcttctttaaaagaatgcttcgactcacatagttacagacaagatgcatttgtaatttctttgttgaggatgagaggaagactggcccaaagtgaaatgataagctcatggaccgaacttgtggaagcatcattggccctcaagagatacagaactttgaatcctctgactcagaatcacatctagaaatttagctctcacttaaacttctgctggaataccagtggtgagacactcacatcatgtctggggggaagtgaggcttgccactgtgtctctggtagaacagggcagagacattatttcaattagtcctcagaaaaatttcccctccctctgagcaatcaagttagtgttactacctgattgttttaattgatggcaaaattaaagtgaggctgccatttgtctgagattccagagcatatagtaattttggaacttgaaatcatgtctaattcaaaacaaaatcacagttaggaaagttctcattgtttacagctcatcttcatgtcatggtaacattttaaatttcagttgttaccagtcatgtgttcaaagcctgacttgggaattgacatctaatagtccactgcaattcctctttctcatctaaatcctttagtcagtcctctggcatatgagaagaaccctcaaagtttggcgtgaattgcctttgattatgtcttagtcatgccacatagttgacttgttgaatttatattctctaagatatttgcacctttttccaactgtttagacccaagtgtaagaatttttacctgtcaccatcacatatcaacttaccagattctacctgctggtataccctgatgatatttgtgggaaatgctatcctggctacattttttgtctctgtttcactggtgaacctgacaggcagactttctatattttcatacatacaaatcatgctaacaagatggtgctgagagcgaaacaaaagcctgaaattttttctttacttcttgttgaaattgatttattgattagaacttttaggctcatatttttagctcatatattttaggctcatatttctcatataacactaatgagaatggagtaatattccccaagaatttccaaatatgtagctgtgcagtttgtatgaataaagattacataaccccaaaaagcttttctggttccccttaggatagtcgttcattagcaacctctaacattgatagtaattagaataagacaacttgggtttaaattctctgtgtgacacatactaaagatataattttgggaaagtcatttgagtacctcttagtctattttacgcacccattaaatgataataataaataaactacaaggttttttaaaaataaaatgagttaattggagttgaaagtgatttttacaagcactgtacagatgttagctgttgttattaagtctgaaaatagacattaagtaggatataaagggagagtttaccttgaagatttgtttatgtattcatgtgttcactcagttcaagtgtattgattacaaactctgtattaggcacagtaagagaggatgagcctacaaaggcctaaatctcttccctgtttgtgttcactgtctggtggaaagacctctaatttgctcccatcatgtccttacaataaagatttgtatttagtgtgcaacacactgcattgcaattattatctacatgtataaacatgattttcatttacataataatggcagtcgaggaaaggagatttattgtatggaaggttgatatgtttaaattgtgtcaaaatttgaatgtttactgtttaaattagggacaaataactaagaaatagaataaaacactactgttcaagttccaaaaccccatttctataaatctgctgcgtacctgtcccattttctgtcatggaacagcacagaggagacagatttactagccctgcacaggcaagaagggaacttagaagattctgctatattcaaatgacttgtgatggcatattggcattcttgacaagcccttgccatggaccaaagaactaccttacttggtttcttggttacttggttgtaaggaaagatgctagatgggtagaagccctgtggaacccacttcatattcatccccaggcaggtagaggaattgttagcctcccattcccaccggctggctcagcaatctggcagtgaggtggttcctttagagcacagtgccagtggaaattggatttggatcccctaaaatcagtgtgaagcagaaaaactcttgattgtagtacctggatgcttaatattgggcttcttgattggcttcgactagggtggccacaacaagtctactggactaacccagggctgagagggtggtcgagttgatggagtggactaatgccattatgggtgtcctgtttgtcacaatggaaaggccacacttacctgctcaatccccatttactttgtattctaggatagaggtcaggaagactatatcccacctgcctatacagctgtggtgtgttgaaagacccctggacttaaagtaagaagatctgggtttgagtctcagtctgtcacttattttctgtgtgaccttgggcaagtcacttcacctatctgagcttcagtttacttctctgtttaactgggaacctattatccgtctcatggggttgctgtgagaattcagtgagatggtgcatgtgaaaagtgctttgtggattgagtattgctctaacaaagcctggtagaaagcagaaggagtaacactgtgtttctttttcaggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagcat

SEQ ID NO: 483 - DNA, 63187 bp, Homo sapiens
gagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccgcagccaccccgctacacacacacacacacacacacacacacacacacacacacacacacacacagacacggacacccttctccacctcctcccctcttgtccctcggctgcccaagaagcttccctcaatctgggaaagtgatcaggtttaagggacctggattggaaagggtgggggcagaagaggggaaatggggacgacgaaagagcaggaaagagattcaacagaatcaaccacccaccactcccaaccgacccgcctgctcctccgagaaagctcctagcgcatcctataacaaaagggggtggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgcctgtggacttgtttatgtgtgtgaagaggcgggggcgagggcctgctgagaggggaggggagcctggaaggggtgggtgtttctcctggagcctgatgtttgtaactcagctgattatggagtgcactgagcgacctgctttttaaataaagaggtgcccgctcctaccccgcaaaacagcgaacgaggagaacatggaagcgctctgtcctaaacgtcaggatgggagaaagttgtaacatagaggagacttttccagaggtcctgttttcacaacactcagaagttctccagcgtactcagcctgcctcccgcctgccctcaattcctttttgacatgtcacacaaagaaagctgaaaggtagaatgtggaggataaactccaaccccctctgccttgggcgcaaacacacagacttaggtatcgtgttaggaggtaagggggttggaaaataatgcaggctccggtagacagtgttgaagggagatagaaagtctggggtatttcccctagggagagtgtgtgggattttgtgttggtgaggactggagtgtagctggacttagagggtttggttgtgtgtgaatgggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgtgcctatgaagggtgtcagagcaggaggagaggtgcagcctgttgaagacagatggcttgtgcatgcctgcacaaacacatggagtgggtgtggtgtaggagggcggctgtgtgtgtgagggaaaggtggatgcatgtggaaggttgggcgcctgaggattaccaaagggatgtgtgtggggggtgggggaagattatctgaggagcacggggtttgaacttcatgagggtgcactgggaaatttggctggaatggcactggggcatgtagggggtagaaaagtgtgagctcagatcctctttatggaaagacaaagcatttgcagggaaggacaccgggttggtgttggtgtttgcctcccccctccttcctccccagagagaagagaattggaggaggcttagaatgagggatgtacatttaaggggaaaagtccttgtgcattggcactgggtgggaacaggaagagatgtgtgcataagactgaagtaagtagaggaatgcactatctgtgcctggtgtcagggatgcatgttgtataatgttttgtaatgggtttcttatgtaataggagaattcactatcaccagttcatattgataatcaattaaagctaatggagtgcctactggatgctcagcccattgctgggtactggggcatggcacactgccctggaaaaattccttctccaggctcagtaaaactgatgcaattttgccagaaatagacagagctcgacgcttgttgaggtttcttcaaggtctataattcagtttctagagatgtttatggatcttgggggccaaagggaagctgacttgaaatatatctctggttttgtaaaaagtggggcataaagagagggatgatgtagacttttgtgtattgggaagggagctggacggtgttgttgtttcttgtgtggggtgtgggctgggaattggagggtgctgcacttcaggtcagaatgcaggtccagatccctctaaggattgagtttctaagagtacacagagcctccttcatagctggaatgagacctgttatgtggagctggagaatggtgaagtcatgatcaaggaagagatggactgggagtgtttgttcatctttgatgttttctgggctacgagtgtaaagctaacctgagtgtgtgttgggggggtgggtatgcatgcaggtgcgtgcacatgcactttggcctggagtaacgtaactgggagaaaactagcgaggtggataggaggggtggatattctggctcttgtgaagggggtgccagtatgtgtttttgcaggaattctgtgtgtctggggaaggataaaaattgtcttggatactcagatgtgcatctttagcgaaaaaaggtgtacacaaaagaagggccgtagactttggggaatgagacaaaggtgtcgttgatcgggtccataccctgagatggctggtgaggcaactgggtaggaacagagtgaaggctgtgcttttgtgatgcacacatctgcctgtctggagcagacgatggggatccccatttgattaggttctgaccaccgttgggcatatgtttgggaggactttatttgactcatgacatttttgaattcatgaagttacagctgtgccattttaagggtctaccttatttttgagagggaaactcatctgtgtaagagatagtttatatagggcttgactattggtcagaagatccggggcagatatttctgagagcagggtggtgaagtgcaagactggattgggaatgtcttagttctagtccagttctaccacttgggaaaagtgtgactttggggacatttttaatctctataactcttctgtttctctttttgtaaaggggcaatataatgactcaaggagaaggaaagttcactcctcttttcccccatcaaaacttgatgtgtttagttgtatacagccatacaaagatgaaatgtaattaaatacaggtgctagcacgtatgtaggtcattgtgaaaataggatctggacccctttctctttacaatgcaacttaatcagtaatcatgatgcccacagcatctctactgctcactcattgtgtaaataaaactttttataactgcctcagtttactcatccagaagctggaggcagccaaacctagattatagatgatggaaatctttaagatctttgagctattcagaggaaaggtagtctaagaatcaatgttattaatgatcagagacagacatttctttattttttaacatcagctatgcagaccacagcaccaaaagaaatgtgacgtggagaacagcaaaaataataattgcccttgacataggcaccatttgaataaaagaagagcaaagtctagcctgcctggtaagaggaaagcctgggctttgggtctttgaaattctttgtgcccagtgcagcaagttgggtacagccactttccccagagatgaagatggagtcgtagaggggcatggaaacacactgaaacctccgattcctcccagaagtcagtacatgctgtcaactcctggctcagagtcaggctcccatccttgagttcagtggccataaatagtcaggagctaagctatttccaagaggcactaaactaattctgttgcttttcttggcgagattgggccaattaagttgattggaagaggtcactgctgatgggtctcacattccccaggcgggacaggccagcagagtttaattacataacatttcccatgtcttcacttccactcccagatgtatcagatgttcaggcctctcctctttccctacattcaggatgcctgacggagcaggcggcttctgctacaagcttctccagaccttttcctgagcagttacagcactcccaccccaactggagggaatgcaagtctgtgcattgcctggaagtgagagaggggatgcaggctgacacagaagatctttagagcccaccaccctgcctcaagcctcacccgcggctgttttactctttaacgaggcaggcagtttctggcgttggggatgttgaactaatgaccgttgctagggttttagatttagttttatttaaaaatgagtttgttggaaaaggaccaaatcttctactggagacaagcctaagccccgtgtggtgctgctgataaggtctgtggatgtactttgtgcatggacaggcatgtgtggagtaagaggagagcacaggatgtgcgtgcgtgcgtgctgggggacacgtgagcgtaggagatgccctgggtagatggggcatttgtagagcttatgttatgggtggcaggtatctggatgcttggctcagattggattgtcattggattgcttcttacaggtgggacagcctgagaaaaaagttggggacaccttccttcagatcatttttatatgggcatgttgaaccttgaagtatgaggccagtgtagatattacctcattcttgcctggatggatttctaacaagattgaggctggacaaaaaaaaaaaaagtctttcagaggactcattttagaacctgtgagaacacatgtagatggccccagagcgttaaagtattttttgttgttgttaatagttttccataactcagtcttttgttttacctaaaaatactgagaggctagaggttgcacacacccccacatggtcagaatgcatttgctgttcatgtccccatctgtgccatggtccttctcaaataggattaattgggaactacggagagcttgccgcagctttggttgtcctcacaggacaaacctatgactgaccgtgatgtcattgaaacagaacagattttgacgtgaaatttcgtgtggtctgttgtgattgctcactttttagtaacatctccagagaagacatttgttgagccccatttttttttgtgggtttgttcagtcagagatttgttggaagatttaaggttctccaacattcaaggccagagattttggaggaaacagtagctaacaagagcccaggccagggtgaccttcagtagcctgaggcagcaggtagctgcctgacttagaagtgaaggaccaggttcagtgactgggctctgtcactaattagctgctactgtgtgaccctggacattctctgtaggacatgactttgccatctgtaaatgaagggcttgaattagaagatctcccagtcccattccagccctgtcactgtaggattccacagtagccacatcctcctacctaatcagtgctaattacctcacttggagtgcaccctggcacgcccttaacgagctcctgtttttatctttggggaatggctgagtcaaaggcagaaaagcgtgcaaaaaatttgccagagtgtttccttttggccaagaatgctctaaacattggcttagcctacacagggtgtgcagagctgaaaggggtgggatttggctttctggtaggtctgatgctaatcattcagcttccacgtgaatgtctttcagtggcaatgtctctgactaaggtaagcatccatctttaagatgatggatgatgatgatgatgacagttaatattagagtacttactgggtgccaggcatttttacagctattacatggcattatctcagtactcaaaataatctcatttacagatgggggtactgaggttatgtgaggttaaggggtatgctgatgttcttggctttccagcctgaagtctgtggcatcccaagcccatcacctgctagtcagattctgttttttatgtctgtgatgtcatccagatgggagctgggtccatcttcttctgcaaagttggtcaccccatagggtaacctgctccctgcccccggaagcctccttgtcatgtgcaagacaaatgtttaggttttctagccacctgctggcaagcatgtgtcagatctgtctcagcctccattggccctctccctttacttcttgttctgttgacaagggaacctgcccttacagaatacggatattgatttaagccacaattgcctccttgtaaactctataaaattggagctggacatctggttttgatccacacgcccacgagaggtggtaggtcccagcattcttgagtcctggaattgcacagaatcaaagtgaaaaagaatatgaatggagagcatgaggtatctttagaatttggaagatggctttctttgataggctagggaactcacaccatttagactggggccaaagttaaggtaggtttcttgctgggaggttggggggcaggggtcactgctaaagactgaggtccccaggctgtgtttgatgcagagcagagcagctgtagagccctccagctgaggatttgccactgcacaccattctctgggcagtaccagaaatagagaagccaaacaggttcttggggtggatgttgccctgtttgaagattgtgactaaaggctcattccttcttcctccactgatttcctcaccatcactaccacatatacatcatcaagacagttaaggacaggtgactttgttctgttgcttaaacatatttgcatgtacaaataaatgttgaacactaacctaatgcctattagaccataggtactcaaaaattatgtatttactttgcttaaaataacctttcatgtgtagggtgataatttttttcttcatatggagtatatagccttttaaaaactgatagccaggttcttgcaatttacttcccccttccctctgtttctagatctaagaccccagcatttaaaaatatccttctctggctctaagtgatccctcagggagtttgtttcaagttctcaatctgagattagtttcatcccacatctagaggacctgcttctaatggttcataaggtacttccactgggttcaagaggaagacacagctctagaaatcacctgctttcccaacaggtgtgtcccatggtggggaagaagcccagtcctcctaacacccacctggctaccttaaatagcttgccacagtctccctgcagagagcccagactagctgtgtgactttaagcaaatcactttccctccgtgggcctcttttcctggaaaagggaggagttggactcactagagggtcacaaggaccctaccagtgtgacagatcacatcttccatgactccgctgctccctcggccccacactgtggcccatgcctgggattttcaggtaaccctgctggcctagaggacttacatagagtgatttggagggggtggaggaggaaattaagttatgtgatgccagataagtcattgaacatacggatgagtgcatgtttatgaagcactgaagaaacaagcttgccagattcgtggcggatcttggattggaagttgggagtatgcgagaggtttatgtgggattaaagttgtctgtgggtagctgaattcaataagctaaatcagagagatcccaaactctgcagagagatcagaccccgcctctaactccaacagaggctaattacaattttgggaagtcctcgaaccacactaggtctcacttcctcatctattaagagctactgactttgattatctctaaggtctttcttgacttatcattaattaaattgtgagaattgggagctagtagaaaaatctggacaaatgcgtggatggagaaggggatacctcaaatggcctaaatatagagggaaatgttctgtacaagtgatacgtttattcttgaatcggagatagcattggaggatatattctgtacaaatattgtgcttcaaatgcttacccctccatcatcatcaatgatattaaaatcattgcttaacctgggatatttgcttaacctgggaagcctccctgcatttccccagagagcctaaggctcccttcccagcctcctgatgccacttagcagcctgtgtttaatttgcattcctagaatgtgacttcacagagaaagggatctgttgttttcatttttgtgtcccccaccttgaatagcgacagccacaggaatgtgttgagtgaatgaatgcgtgaccagccattgtgagctcagaatgtgcagcagcgatttgacagtgccaggaacttggctcagagaggcagtgcaccttgccagggcttcaaaacagtgttacctttatcccccttttggcctgtcccaaggctaaggtcatgaatgctcagcgcttggtggccagaaaaggctgttcttactcccttttagagacctttcttccccacatcttagcctgcttagttctcctgcaaattggggctcttggtcacagggaatcgggtgtcattgcatacgcattaggataactcctcgttagacactcggaaagcaactcaaaacacacgtgtacagattattcattaagcagtctgttggtggtcacgtgctaaatgttggggaagatgcagagatgaatgtagtgctgctggccttggggtctggaaactggtgaaggaggcagtcaggttacaatcatagtgctccagggagaacaagggaagcaaggaagatggaatacagggttcccacttcaggtgttgttttttagtacaaaccatgattgagaatcctcttggttcaggagcaagctggagggtccaggaatggtctccgcttccacatgacagtggttttcttgtccctgaattcccagggctagggtgatggatgctcagagaccattgtgatgggagcccttggtccttgtggggagagtcgggggaacacgcatgttgtacaggtgttggggcttggggaggtgtaggtgtgcatgctcaccagggtacttctcagaagtatccctgctcgtggcatggtgggggtgagtccacctcaggcccctaagctgtgcttctacttcctttctaattatacagcatgtattgtctctgtgaccacttctgacacaggaacagactgccatctactgtccacttctgtcctgagtccctcctgctcaaggaggcatttattttttctcatcctgtttttaatagatccggacaccaggagaaacagacgtggagtcctatttagtaatttttttagaatttagaagggagccttcaaaaaacatagcacatctgtcagatggtttccgtatctgtttacaaagtattattgtaaggggccactctgctgccactgagtcttgctagccgctgtgcgaggtgccgtgtgggataccaagagatacaaagcaaggccttaccttcaacagccttgcagtctacttgcgaatacagtgtagatttgcagagaagcagactacaggatgtggcagtagatatttggtaagaggcatctgggtggtagggactacagaggttttgggagtttggaggaaggaggagcccttataggctgggggatttgggaaagaccaatatgggtctccttttagcaatcccagtgtttaggaagaggcttctaagagctgcgcgatgttgtgggacaggctatgaactggaaactcaggaacctggagggcctgaggtctagtccagcttctggcagtcctgccctgtgacccagggccttgggttccgcatcctcaaagcaaggctgttggtcttcttgtcatgtaagggcccccccatccccgaccctgcatcatgtaccactcttggatgcagtgggaggtggtttcctggtttccagcttgtcaagagcaatagagtcaattggatcccatgcaggaaggatacctggatgcagggccctgtgctgatgaccccacatgcagcaggagagagagaatttccccaggggagttttgggtgctgttaaaatacaaaggggggaaatgttccatgcaacctctgcatgccactcctctccagagctttcctggactttccttccaaaaatatatgtgcatggtgctttgcgtccaagatagctaccccaaaagaaattgtattagtattctagcattgttcatagctcaaatctaagattccttcacattagaattcattccatgattgtttttatggaggttttctttgagtatttgagacttttggtagctgtggattaaaatgaggaaaagattgttttctatagctcttttactccttgtctctttttctctgtctttcttagcatttaaaccaccaccaaggaaacctccagggtgtttattgcatattcttgccttttgatgtgtgtgtgtgcatgagagagagagaaaaaaaaagaaagggagagaggagaggcgagagagagtacaagagagaaagatattttagactgtggtctattagcatgtctaggaaatcaagttgaatttggattgggttacaggttgagagacctcagctcgtcactgtaatcctctgacatttcccttttactttttggctcttgtctgaatcaagaatacatcttcccgttccctcttccatgtttacatcttcttttggggcagctgtataaagttactgtctgtctacagcaagtctccttaattcttttggggactgctcgacagaggcacagtcaaggatagaaccattagagacggtcagcttttggacaaagacaaaaaaatatgttgaggaataggagaaatgttccaattgtcgattatgtgttttcctgtggtatgctgatgtctgtgactgttgtccacagaaagagagcgtgagcaggggctggggcagagataaaagggagattctccccaaaccaacaaatgtggagagagagcaggagtccccagcaacagatatggagccaaacaaccctgggaagtaactaggaaacttcctggtgacctgagatgtgttttgtaatcactggtgaaagtaggaggagatggggtagaggagagttacaggtagagaagttccgtgggaggagaccccaaggtgagagaaagcagggacttaaagaactgaaagaagcccagggaggggatgaacagagaacatcccatatatcccatatccagtatggtggagaggtgggcgggagccaactgggagcttactttttttttcccaggggcatgggaactatggaaaactctgagggcacaattaagcttttgtttttaaaaagatccctccggctgcagtgtggctctgaataaagagttgttcaatgaagaaaggaatggctgatggttggattgatggaagaattaatgaatgagcaaacgaatgcatgagatgcagagggaacgcagcaagcctgatttgatctctggttactttgaccagtactggctccaggggcgattatctcagcctgggaggccagggagtaatgcattgattagaatgtctctggacacatggattaaaatatctgatattttagggtggttgatagtggggaggacttctgaaactttttccctcttctatgcatttccatcctaatttgatttcattcaggatcaaaaaagaagatggcttttgaaattacatcccagaaaatctgaaactgtggcattgacttgctccagagagggctgcttgcatggaagaccttttcataggctcatcgtggaatagggacagatgataaagtttcttgggcatatgaaggggtcccagatttctggacgtcagatccacccatagatgattccttggattaaatgatgtgtgtgtgtatgtgtgtgtgtgtgtgtgtgtgtgtgtgtgtgtgtgtttaaagttttaaagtctcctgaaaattaccaagtgctactgaacattttttttgtcagtagtggatatctggataatttctttcaaggccacattgcttagcatgtataaggaaagtgtgtgcggcagagacccagatggacagccggcatgccatccagttgcttggggagtgtgaatactccttggcaaagccaaagggagccaaagaggacctctagtgtctttgctctcccatgtcctgactattccaatctcactttgcattttgagatcttttaacttttgctaacagtgattgctcaggatgtcattcaggccaattaaatttgaatgtctagggttgggacagaagctcacgaggtgaatgcaatgtgcagccacgttgagaaccactagctgacactgctaatctactctgctctcctccctgccttttggcggctttgccatgatatctgtcccatcctcacctcagtttgctgagaactcctcacttagttaaggaagttcttctaaggatgttcaactaatatgggctaaggcctcctatcccctaaaaatccagcatttgcctgagaaattggacgctaggaggataagacaggttcttagcagattctgaagcactcaccgtctctcatctgctgaagggtgtattgaggatgaatgatggggaacagcagggagaaagaccagcatccatagggcagtaacagggtgcagacacctatttatatgtgtcatcgtagttcccctgacagctcccagaaccagatattataccaggcagatataccaggcttacaggcacctatttatatgtgtcatctccttagttcccccaacaactcacagaggcagatattataccaggcttgagggcacaacaactcacagaggcagatattataccagacttgagggcacagtttgcataatgcattcataatgcaaagtggtttgtgatcttggaatgatcagacttcctacactggttctccccagtaatttgcatatcagccagataccctcctctagggttagctatgatcagggctgctgatttctggcactgatggctcaatgggaaggaaagcgcctatcccctctgttctgtgggattcagcaatcttgggctggtccttccaggaggcccaacctgaggacatgctttaaccaacaggcctttatattgagaaaatagtagttctcttccttgccatttccctgttaggaagccatggcttgcaggacagccagggagtagaggttcagagaaggaggctaaaaaaatcaagacctgaaaaagttaagtttccaaccatatattcccaaattgtagagtggaccatatggaatcattgcaatccctgggtttctcatttacaacttttgcaaaagatattactatgtatgctgtcaggcatgctggagccggatgtctagcacccattgctaagtgcatgcttcggtaagagctttggacttgggattctccagactgctgagtgacctacgtgtagtttagcaacataatgcttggaatgagccacgccgacctgatgcgagaaccggatggtagccgaagagagcaggccaggtagtgagacaactatgatctgcagaggtgggcagcggggtggagacaggcttcttctgcaccaagtactgctacctgaactgtacatcacagagacaagccctgccgagagcagtggaagcaggaaaacacaggcctatctctgtgtctgtcatgtaagtaagtctctcttggctgtgtgtacctgccaccatcaccccatcccaccccaaatatacagcatcaccttcagctatagcttttggtttttgattaaaggacagtaatatttccaggagggagaagagtgatgaacagaagcatttatgtatggacactgggcaatttattgtttttcaaagtctaatctagaacatgtttgcaagaaagcgtgaattgagtaaaaagtttactatcgtattaaggactgttaggtacaatgactgaaggaggagttaagagtgatccttcaataattcccctgtgggattatgcacatttaaggaaaaatgttcttcaggctatttctgccttagagctaggcatcattacagcgaaatagagaactaacctttaagcaagaggaaccaagttctagttctatttctgtcaatcactgtacgcacaacctctcaaagccttagtttcctctttgcaaagtgggataataaaccctacctacttaacacaatgtggggtttcaggtgagatgatgcataggatcgtgcttggcaagctgtaaatctgtaaattacaaatatatattatggtttcaactggtacattcctaagcgaatagcacattgctctgttgggaagacggctcttctccaagtcaggctgggataatgttccctgacaagacactgccatacctaggtgttccccaaacattgtctctgggaaccttgaggaagcaccataagacatgggaagaaatgttacagcgctggcttgaaagaataacaatgtatcagtctacttatttctgataatgtcatcttgggataagagactcagggtagcttagtgagggacatgggcatgcactgcacagtaaaaatggtgtccaggaaacctgggtttatttcagtatgggttgcccacacttctgccaacccagtcccctacttcgtccccagctgctcttgatgaactctctgcacacacttgcacctgtatctgtgaaacagagctcctcctcttacatgagaatggatctggttgcaaatctaatagattccgctaccacaatgtcccctgccttttttgtttacttcatttatgaaaatacccttgaaacatccatagtcccattttgtagacatggtgctttatgtctttgagattattaaatactcatgctcctttctgattgctgttttcacctcttctttaggcttgggcttttctattggtggaatttgctgttccttttcatggtgctggctttcctgagttgggtggttgctaattcttattgccagtttgtcttctgtgacagattctccgacatgcctcggatgtggcttccgtgcttggctttagctttttatctgggctctcgtgtcctgaatatttaccttctttcaggaatttctcacagcttctagccaatgaaagtcccccttcttattgtcaaacccagacagttataattttattttaaatgtactttttgttacattgttttgggagtagggctggaaggacttgctaatggatgagtggtggaaagtgagagaaagaaagatatgatggaagaaggagcaatcaaagccccagaaggaagctatcgcattgttcttggattcctaagcctgccagaaagagctgacttactttacagtttctgagagaactatgtgtgctattactagaagcacaagagaaagaaaaataggatgttcagcatgcttcatttatctaatgtgaaaaatgaactctgcccagtgacttaatgggcataaactctgtttctaaaaaagccactcattcggcaacgcacttctgagttcttgatatggtaaggtattgtgttctgtgctggacaggaatacaaaaatgcacggttcctcacctccaagaacttatagtacatgtagggaaataagacaacccctattgaatatcactcaagatggaaatgactagggccatggaatgtaacacacagagggtacctggagttcctaagacttctgatggatgattgaggagagccctggatcaggtaagcaatttgaagggatagggatagcacagacagcacaggggtggaaacaagtgtggagtgtcgagagcttgaccagtacgcctgaaagggagggagtgtacacagagcgttaataggagctctgtctcgaggcagcttccctcagcccctcccaggacatcgaggttttgggagaaagagcctattgctcactctcacggctcttctcctttttctctgctttcagtttgttctttgaactttttggaaacttcccctgttctttctttaacactgtgcttcatctcttggggttctacgttttgcaggttgtagtgcttgagatccagccttcccaaatgatttctctgaatttagtatttggtatgggttttgctattttgctgccatcccagccctagcaaagaaacgacttacccggagtatggacagggcttcagagaaaacccctaacattcctgactcccgactttacagagctctgccaaaccttgccttgcgggagtaagaaaagcgctaacaagccatcctctttggtgtcaagtgcagacaaatcacttagcccctctgaggtcctccaacagtaagctactggtttgtgaaaccccaggataatccatctgatttcagtcctgcatttagtcacttagaacattctcgcacatgcatttgctggctcatgtacatacgaatatacacatatccctctttgtgccctttcttagcctctgatgatttcttctcctccaggaggcaggaatccaaggcttataaaccatgacttctgggaagttttttcttctgcttaaccagggtatcattgttttttctgccttcccctggagaatcactggccactgccctagtggttggggcaaggatcagaggtagcttgcattctggggtttgtccccaaagcctcggtgggactctgcattggggtctgtagcctggatccactccagtaccttaactaatctcttgactcccagatggtccaaaatatgtggatttagaagagcaacagacagctgttcctctgggcctctccaagaacacggtttggtgtctagaccaccttagagaaacatggcagaggaaatcatggtggagcagcatggaaacaggtgaaacccagacttagtaccttgttaaattccatcctggagtggagataccagaggagcagatattacctttattaactgatagaaatgtttggggatttctctgacttcttgtagggttggataagccccaaagtgaagagaattttgctccttgttttagccattaggaaactcaagaccctgctacagtgctattggtttaatttttccctatcacattgcctctgcaacttctgaatggttgcagccatttcttaaaatttccctgcattgtcactcagacaacaagaatagatttggccttcttcatctcaaaataatggtcatgattaatagttattggactgggaacagtgctcagccctctgtacgtgatctcaggaatcctcacagtactcaatgaaatagcaattttattatctcatttttgcagacaaagcaacggaaacttccacacattttctacattgcacctaagatcatctgagaaactatgctgtacttgtttttctaatgtatgatctgatttttctattataatgttaattctatgaggacagggctttctgtggccttgcttcattgctgtatctccagcacctggactactgcatggcacctggtagttacttagtaaaggtttttcaaatgactgagtaactcatccaagattaaatgtctaggaagtggtggcaccaagcttaggacgactcttttctgattccagagtccagacagccctaaccactatcccacactaccttcttgtttatttttaaatcattttccttcccttcaatccctctccagtgccttacaccttcttgctgtaatttgaagcatggccacagtaagctacctcaagtttctcatctgtaaaatggggataatataatgaactaccttatgggattgtacccctctgcatggtagcctcatcctactgtgcctcctaaccacggcctttaaatcagcaggtatagttaatatatttagttcttttaatctaatctgaaacacaaagcatttgcttccttaattcaagatttttggctttgcctagactaagcttaaaaccaaagaagtactgcagaactgactgaggctgccagaagtaccacactcttgcacccagccagtgggaagtggaaagataacagctaagcctttggggatccttccagaagtagtgatgacgtacagcattctttctgattatgaagtaaatatctgttctaatgtatgttcaacatagagagttaagaaaatggggaaagaataaagagtaaaacaatgaccagaaataccttcaataccctttgacattctttctctgtgtgtgcatgtgtttgtgtgtctttgtttctgtgtctgtatatgtgtatttcctttatttttgtttttttactttaatgtaatttttagagacaaggtcttactttgtcttgtagactcgcgtgtggtggcgtggcactcatggttcactgcaacctccaattcctgggctcaagcgatcctcttacctcagcctcctgtgtagttaggactgcaggcatgcatcaccattcctggctaatttttcaatttttgtgaagacgggctctcactatgttactcaggatggtctcaaactcctggcccgaagcaatcctatcaccttggcctcccaaagtgctgggattacaggcgtgagcgaccatgcccagctcccttttataaataaggggctcaccatacaatataaccagtttttacctggcattttccagtcattattgcattgtacgtatctccccatgtctttttcttttctttttttttttttttttgttgacggagtctcactctcttgccgggctggaaggcagtggcgcaatctcagctcactgcaacctccgcctcccgggttcaagtgattctcctgcctcagcctcccgagtagctgggactacaggcgcccgccaccacgcccagctaatttttgtatttttagtagagacggggtttcaccatgtcagcccaggaaggtctcgatctcttgacctcgtgatccacccgcctcggcttcccaaagtgctggaattacaggcgtgagccaccgcgcctggccctctccatgtctttaattattcttgcataagatgacttttcactgcataatattccatcacataccactctttaaccattttgcttctggggcacattttccttttggtcacactttttatactacagttgccatccttttacatacatttgaatacacatatctggctattctctcagaatagatttccagacgttacctttccaagcttgaagatgttaacattttaaagaaagatggttattcttgaaagccctgacagctctgagtggggagccggggctgatggttaccacaggatagcggaaaggcacactggctggcctgtgtgtactcacgcatccccccacctagggcagccttgggaagagcactcaggattatgagaaagactgtcgcctcccctttgcttcattagctgatcctctaagcatatgtgctttcttggtctaattttcggattggtcttctcctatattctcttcctactccccaccccgaccttacagctaagtgcacatctcatgtagtgcagtgggaaagaaccgtaaggcagaagccgggctgacttggctgtgaatcccagctccatcacttgctggccaggtgactgagtaagatcgtttacacatccatcatcctcaagtttctcatctgtaaaatggggataataatgtaactgccttatggcattatataaggattgtatgactgaacacatgtagaatgcttagaacaatgcctggcatatatgaagcatttaatacatggtgtattaaattagttttgaaaagaataaattaataacaatgatgaacatttttgatacctattttcctattgttttgactctcaaagccagttgcaagcatatttagcactgtgatgtatgtgtgacttactgcaaagtcttttttccagtccctgataccagctctctcttcaccttcagtgtttcctacccctcctgcctccccttccctaagaatattgctgtttcacagagtgtaggctttcctctggcttccagatctgcccacatatgcacacttctctttcccatccctgttggactctttctccttatcagtttatttgttccagttgggaagaactggaacctggtcggcagcttttccagttggctttatctgtgcgctgcattgtaaaactgttctctcttgcttagaaatctctttgatccatgtttagctgtatttattcttccaacagatgttttgggtagtgagaggattttcttctcgcatttgcctagtctcatgctccttcatgcttcccacttgttcgggatctttttgccagctgaccacagacaggggccatctgtcgtgaaggtctccctggcccagcagaccaggaatggcccagcaaccaagactttctgaagggcttagtgaaggggaggagggaggaagatgttggagaactgtgtagggtagagtttgagtttcccagacacattccaggagctcttttgatccaaggtatacatgatttggcttgtgctctgtggcaggttaacaaaaacacaaccttccattgtctcctgtagacaacagagtgaggcccttgggcatggcaggtagcctaagactacccctgagagttgggaagtgtatgagtctcctggggctgccgtaacaaagcaccacaaattgggtggcttagcacaacagaaatgtattgcctcacagttctggaggccagaagtccaagatcaaggttgcggtcagggccgtgtttcatctgaaggcccagggaagcagctgccccacgccttctcctagcctctggtagcctctggcatttcttggcttatagatgcatctgtcaaatcctgtgtcttcatatggctttctcctttgtctcacactgtctttcctctgtgcatgtctgtgttcagatgtccctttttataaggatgtcaacccaattggattaagttctaccctaatgatctcattttaacttggttacctctgtaaagtccttatttccaaataaggtcatgtgctcaagtactaaggggttaggactccagcatatcttggtggtagacacaattcaacccataatgggaaggaaagatgttgggcacctgtaactcctccaaacacccacagagtgcagggtgagctgtgtgctaacacatagtcagttctctttggggtgaggaggcctaggggcagggcccccatgtggggtctctgtccacaccagcaacaataacaaccagggaggaaagcatctcattttccttggctcagttcagctttttatgtttttagcacaatgcctgctttgctcttccaacaatttgggaatctctgggagctgtgcatggaaagcaaggaggacagcggcgagaaaaagggggagtagatggagggtcttggaaagcagagggcctaggcaggcagagaggacaggaaagtatagcgagcagagcggcaaattggtggggaggtgcagaaggctgcttggcagccaggagttcttgccctggccctgccatgaggctgcatgtctgtggcctaggtatttaccttctccaggcctcagtttctctgtaggcaagattgggaggtggatgggtgctctctaggatcccttcctggccagaataacattctcagcaggagcctaacgtgtggagcaaatgggagcactgggctccggcctcctgcagtgagcacagcccctgttcttgtggaaacatcttccaatagggctgccctgcctacagggtcatgcggcatgcatctgctgcctgcctgcgctcttgaaacagcctccactgctcccctcccagctcctgtctctctgcacacgcaagcgtgctactccttttcatgatccccattagtattctttgacgatggcatacatctgtcttcgatcgttgtcagctctgggaggcttatgccaagcttcttgagcgtaacccatgactgcctgggttaggtgttgtgagctgtccaggaggcaggaggacgatgcatgcaagtcagggcttagggcagaagtgcctgggcctggcctccccttggactccaggagtcctgtcctaacagagcccacagccccctatccatctggcctctgtaacccctccccaacacacacacacacacacacacacacacacacacacacacacacacacacatagcccctgtgattgagggggccccaattcctgttcatatcctccaggatagcccacctgcaccctcgacagtgagagacaaagttctattccctgtttagatgggtgctggggacaatggaaaggaggtgtggctctgagaagttcatgtcttgctcagggcacacagcagctgatcgggaacatgttgctgactccaagatgctgccttgcaagaagctggctctatccttcttttggctgaagtgcctttcatggatggtgagggatgtgcagggagaagtgtcaggagtgagggtcagtggttagaatcaggcagtccacagagtctgagaaagcaagacattctctggcagtctgggggtcatgatcgcccaccccagcccagataaccctcacagctgtgcgggccactagagaaaaaggagggcatgtttggggcaggagaggcaaatgtttgcttatctgtgacttcttcctccaagcatgtccggacctccagtcaatggtgggctgtcagtcgtcagctgaggttgagctttccttagcaggagcactggtcacttgggctgggatggttcttagtggtacaggatgcactgcaagctttaaatgcgagtggcatcatccccttccggtcaccatggcaaccagaaacaccttgacacatttccaaatgccctttagtagggcagtgacagcccttttgagaatcacatagaatcgcattgattgatgagtgaaaaataaatggatggtagcctccttttgtgatttttgcagcggcctttagcttcctttactcaccccagaaatcagtgggaccctgggagctgtgtacccctcagacccagttggaacccagccaagagtacttaatccatccccacttgtggggccaacggcacctaaccacctcaggcacggtggacctggctcctcagagagctctagggacagaggagagaaagggtctgcattctgtttgcagccctgatcgtgagctctgggggtcctcttccacccccacccccacccccagcccctggagcaggtactcggggtcagagctctgctgagggtctggctctgggaggggaggtttgtgtaagattccctcccacggttcagcacagatgggatgacaaggaccaaattctgtttctgggctctgatatttgccaagatttttaccaggcttcctggaatagacagggaagcagagcaagctcccgtaggtcaagtgatttgggcccgagttgacccagagtccctaaatgactgctgtgtagctaccatgagtgtgctgagtggcccataggggcaggtatgagagaggtgctgagggaggcagggggcccgcagaacggcctcccatctccactgcccgtccccaggtccacaggctcacagagcagacacggtctgtgcctgggtttgctcacccacaagaggaagaacataacatctcgctccttttgctgcacaggataaaacgagaacagagaggaaacaggaagtgctttgcattccagaaagagcagcaactgtataaagtcatgcatattaggatttgaggtatgcatggtcagaagttagaaactaaccgaatcttgtcattgccaggaagtttcggggttctgtgactggtggccactgatgttcctgtgttcctccattccagctcctaccttgactgtgtcctcctcttcacacctaacttctttagtgaaggctccatttcctcatttcctgttcaatgcttaaaccccttgcaatctggcttctaccatcgccttatcacagacccttctctggctttgccttgcctggcccttccatgatgtcttctttcttgaaaccctctttccttggtaggataccacggcatcctggtttttgtcctacctctgtggctgtttctgcgtgctttccttagctgacttttgctcctttatctgacctgggctctcctctctccatacactctccatagcctattctaagtgtcccaggtctcttatatcttatctctcaaatgcacaattactttgtgttagctacagacccatatatccagcttccctatagataccccaaatgtctttgtaggctcctaaactcagtgtatgctaagctgaacaggggctccttttgtgccccaaactttcccaactccagtgagtcttctccattgtctttcaccttaataaatggaaccacctgcgactctagtgtgtggtccagagacttggaagtcacctcagcttgtctctctgtcatccgcaggatcgggcagcctccaagtcctcatcattctaactctcataatgcctctggagtttgtccagatctcctcgtcaccactgccgctacgctaatcaaaaccaccattgtctcttgccatcctccatactttgcaaagttaattgggtcatttttctacttgaaatcttataatggctctccagtgcctctgagtccttgttttttcaacactgttcacactctccccacctctctctcactcataccccatgcaccagccatcctgggttttgctgtttttgtttcccagaatgcacaatgcaccttctggcctctgagccacagcacctgggtatttgctcacactactgcagctctcctcttccctgccaccacgcctttcttgcctgactgttagtatgcagcagtggccacttgagcatgaccgcctctgggaggctgtccctagtcctctgtcgcattctggggctccctatcacacactcccattgcatgctgcagcatcctcagcacccagcattccttattgtagttcctgattcaacacctttctcaggagactctggacttcttgaaggcaggaacaattcccacttgttcctagtagcattccaaaccacacgtgacagtgtctggcttataataagcagccaataaaaagttgatgaatgaatgaataagtgaaaacagaaggtgtttgcctgcagaaatctggaataagatcaaagatcagagctgggattaaggaaaaaacttccttggggtggcactatgaattcccagaacaggtgactaaccctcattcactttggcaaatgtttatcccatgccacgcaaccaggcaaaaagttgaatgaggtttaatcccttcccacacggagcttattccttctttggaagtcctttaaacaagctctgaaatgattttggcaggtagacaaactggtcctcatttctctgtgaccagtaagtagggaaagcaagcacacatacacacacacacacacacgtgcacacgcacactgacagacaaccttgctcactcacatgggcatgcccaaacccttcttctattttataggatggtaactcactctttagtttagactcttgacgtgccatggaaaatcccactcgccctagaactgggggccgggcaggtttgactgtaacaacgaagcctggagcttactctttgctgattggctttcctttctgtctccatttttcccctggtgagcactgcagttgtgttcttcctcccaaaggtaatgcctggtttggctcactaaaacctgttctttctgtaccgagagctcatcttctcttcctcttctggattctcaaatgagatgacgtcagaggatggaggccaaccacacccttcctccttgaccctgataaagtttcttggaaaccctatactcagaggcagccaattcttgccagtggaagagtgaaaagagggcttgggaagctcaaggctcagtgtctgtccccaggtcccccagttaaagacacatctgtccttcactctcaaagatgttgccattgctcccctgctagagtgacacactgcactccctccttcccttcacaccccagcaagaggctatttcccaggggtcttataagcagatttcatcttctcttgtgctgttttcttatttcaattatcttcagggaggaacgtgcatattgcgtcattgcctggctgtgaaatttcatttccatttctttacacctgcagttgcaatacgagagagaaaaggccagagcttagcggatgtcctagacgcaggttatcaaggtgctgtggctgtggtttcccggaaaaggccttggtcccagagcacattttatcagcaggaccttcgaggggctgcgttccttcaattgttttctctttggggtctctggtctccagttctttcttctctagcatgtgagatctgtgcttttgattcatgcctttaagtctgacattgaaaaaatatctgatttgccattccagatgctcgtcctcatttgcaaattttcctaaagggccagattgtcctctggccttttcccttttcctggtcccacctcaccaccctcccactggggcttcacagaggcagagctagtctcctttcattttttaaaattaatagtcttcaatttttagaacagttttaagttcacagaaaaattaaccagctattacagagttaccgtataactcctccccctcactccccagttttctccattattagcatgttgcattagtgcagtacatttgttgcagttaataagcaaatattagcccatcattattaactcaagtctatagtttacattaaggtgtattctttgtgttttacagttttatgggttatgacaaatgcataatgttatgtatccaccattatagcatacagaatagtttcactgccctaaaactctcctgtgctccacctgcccatccctcctccctcctctgccaccaatccctggcagccaccagtcttttgactgcctagagtttcgcctttttcagaatatcatagtagttggaataatacagtgcgtagtcttttcagactggctcctttcacttagcaatatgcattttaagtttcttccatggaaactttgctttcatccttttatcaccacaaggccagtcatccaaggaatttctccatctctgtctgttcctttctagttctatgtgtgccactgcttggcatagaataggtatccatttaatgaacattccctttcaccacctgggacaccttcccagggataacaaaaataaaaccagctaggtcaatagcagagcccccatcccagttttaacctcattctcccctctttccacaataaactggatcagaaccagcagctctgtaagactgcatttctttcccttaataccaggccccagagagcatttgattccttggcagagaggtgtaggcttaattaatttttctccttttttctttgaacatcttggaacacacacacacacattcgcatttatgcacaattgggtgtatgagaattttaatggcaggtggtgttagcagttcttttcctcctgatacagatcagggtttttccatctgggccttttagcagggcctatgaatattgactttctaaccacttggatttgggtggagtgtgcagagtgggattgggggggaaggttcaagggagaactatacttatgtataaatcacatgtgaagggagttttgaagtcattattgcttcaggatgtgcgaaccataattattttttaaggtcttgatttgcccaaagagcatttcccagggttgctgctccaagcatgacgtctgtgctgtcaggaggtgcagcatagtctgattcgagtttaatcgctttaaaggaggccctgggtaggatctggtctctaggttctcagctgtggtcagtcctccatgcagcaaaacatccagatgacttagatgattaagacagcagacttaaagtgaagaagagattttttcccttattctttccttttattattagtttttaaatggttggctacatgggctgttggtcattctccatgttctctgtgctctcctcagctctctgctcaaaacaggctgcaccggcctgcctaaaccctgaaagcaacttctcagctgcctactttctgccttttgacccccaagccaatccccatctccttaccaccctcccgccatgtcctcatacacctgcctctccttgacttcattcttcatgctccatcagcaacagccctctgtcaataatgattgtcccagggaagtgtattcaagggtcacataaaatgtgccctctctatgtgttgagaaggttttctgtccccaaaggagctctctggataatgaggaaggttgaactggggcagcctacaggaagaagcccttagaagggaaacctgtggcataaaccatgctgatccacgactcttattttggaatagctatttaaaaagaaatatgaagaactcgtaagacttggaaaagaaaactagagaatgttgaaaatgtccaagggttatgtgtatgatgtgtatggggaaattttaaaagaatgtggtagaaaactgaatttgtggtaaaatgttgtcacaggacggcctgttctttcattgaattatgtcttagtgcagggatgacaaataaatacagcaactgtgctgccattctcacatcttttcctacagtaggcatcactaatcaattacaacattcttttccactgtcatgcctttgcctacagcagacatcactaatcaatcacagcactctctctcattgagtttcaaaggttttttaatcctccacataggtctctaagtagctatataccaattactttgatttagaacttggattaccaatttgccatctctagtttaatgggaagaacattaggattagagtcagaatacctgaattcaagttactgacctactacttaataataattaattttaataattctctaacctcagctttctcctctataataagaaataatgcttaccacagaggctcgaggtaaggattaagtaagataatatataacatgtaagataatttgtgtgatggttcctagaatagtacctggtgcattgtaagcacccagcaagtgatagccaagtatgaatttgcagcggcatggacacatcatgccacaccccagatatggaacaatagttaggattccattcacctttgcttcttttaacatcctcagtgaaggcagatggagaacagctggaccctctaattctacctgactttaacttcacattcttaagatgcttattaaatctctctttcctgaactaatataatgcttccttgttaccctggaaggacagagttaacacccatgtattatgacatgatggatgttctttttgcgcacactgcatgcatagccatgtgccaaggccaggcctgccttagctttttggttctccagagcagcttcactgtgactgaagagagccagggaagacatcttggtagagctctttatatgactcttttcagaatgtttctcactgatggagatgacagaaagctaggatgatttgcaggcaggaggacaggcttctttggaaaaggtttcaccatagattacctcaatccagggttggaagactggaaagtggtctgcagggcatcccaggggatgccttcttcaagacaatattagactagcattggaccctgcctccagactagtaaagggttattttcagagcagcaacaccagagaacatgttttgagcaaatcaaatccttaaaatcatgatttcatacatcctgagatactagtgacttcaaaatgcctttctcaaattatacatatagtgccttctgaatcaactgtcttttttctgtccaacagtataaacataatctctgccctcacacagcttagaaactgtcatgagaggtaaacaaatacacaaatgacaaggtaaaatagaagagctacaaaagagatcatgaaaatatccagggagttcgaaggtggcagataacaaaaggcttcgtggaggaggtagcctttgtggcatttgagatcagtcctgcagcagggttataggtggacaggcagagatggttgggggtgggcggtaggagggacagacagaaggaaccacaagaatgaggatatggagaaaaagaccactgaagggtgcaaattattaaggatggatttatgtaaaggatgtggcctaagaagaaggactcttctttatgatgaaattaggttttagaggcagaagtctggtgcttcccggtactaaaatgaccccagtatggtgtctgcagaatacttagataactgcatagatggttcagccttctttccattataccacactactgggttaccaacttgctgtgtgaccttagataagcaactacctctctctgggcctcagttttcatatctatgaaattaggaggttgaattatgtcttggcataataacgaaataaataagtgatttatttttatttctttgtcattcctctttgaaatgggagtgggaataaagtggtatttgtttccacatgaaaattaaagccagggggccaattctggacttggcttgagctgtgctttgtctgtttttctgcactggcccagtaccctttacactggtgtaactaactccctggaaagggatgcaggtagacagcgtgactgttccttcctatctgagaggccccaacagattctatattgcaggaccaccaacttggaatttcagctcagttcagcaaacacttttgactggttcgtgtgctagacattgtgctgggcttatgtggggtagagatgcctgctaatctaaggctaacaggaagacagggaagtggtttccagacctgatgcttatcagagtcactgtggaagaactttttagaatgcagacagcccccaacttaacagtggttggactttcaatttttcaccttataatggtgcaaaagtgatgggcattcagtatgcttctcaacatacaaagaggttgtgtgaaataaacccatcattaattgaagatactgtcaatcaaaaatgtacttttgacttacagtgttttcaacttaggaggggtcataggttgaggagcatctccacagattcctgagccccatcccttgatgatgatgatccagtgagcctgggtggggcctgagaatctgcatactaactgctgaaggtgagtgtgatgcagggccaagcttcagaacctctgatctagagaagattctgtgtcatcacagctcagggtgaccatgttctctcttacttgcacttacatgaattcatatgaattcagtattacatgagtaaattatgattatatgaatttattgagtatcctatgtgcttgatataggtgtttacatcccagggttggggggtagagatgaagaatataagccggactatgttaagatcttcacttctcagcacctgaacaactggcagcctcattaggaaggcaagtcattcacaggtgaaatgacatcatggtcgtcttcttcattcttctcttcagcatccatttaagactcacattttatcaccagagactgaaaagagccacctaaggcaggcaggtcaggtggtgttatctctttatttccagatgtggaggctgaggctcagagaggtgaatccatatgtccaagctcacatctcccgccctcagtccagggcttctccccacttcatgggagaagcatcctcctccccagagcagtaggttctggagctgggagaggccactgtgggctggattgttggggacagcttcagggagagcccgattcaaggcaatagagaactttggctgcaggccgttgcctagaatagggcagctgacacacctttgatctggaatgattcctgctgctgagaatgaggttttttatatctggattctcaggtagtaacaccacgacaacgtgtgtttgtgttatttcatctgcacagcattcacgtgtagcagagagaaggtagtttattccccagaagtttaccagtgggaaattgaggtcaaaggtaggactttcctaaatgaagagaactactatttattggatgcctcccatctgccaagcagtgtgcacagcaggcatatatcatgaaatgcctcatttattcctcataactgtagcctgattttacattcggcaaacctgaggcttacagaaatcatgtggctcgcactcagactgctgatggccacgcaaggctttcagcttctctgatttccaggcccccatccccaccacactgtgctgtccagctcacctggtggaactggatcctttgagttccaggccagggatcctactgagctcttccatcagggaaaccatagcagtagcagctccaccaaggacttggcatctatcttactgcagcatccgtgcctgtctaatggaaccatgtaccaggagtagctacccaagaaacatttccaccagaaacttctctttatagctccccatcgagcctcagagagctgataggaattgctcaagaccacccaacttgtaagtggtagagctgggactaaaaggcaagtcccccaactttcagcctcactcgtgcccaatgtgtctcagcctccctgaagaatatcagaccaagatggccagaaaaggaacctggaagggacgtgtgggcgtcatgcagcccttggcacagtcttcaggctgagctgcctccaccttgtcatctcatcagagctttacatccatccttgggagaggccagctccatgacctctcagtgtcatttaggatcttcttcctaaacggctaacccaagtctgtccgctgcatcctacagtgagatgcactgtggcgagagcagctattggcattctgcttacgtgctgtttccagaggtaaactcagtataaatggatctacagcctgtcccattttgtacagtcgagttctaaaaccagcctgcaaggataatgctataaaaatgtcctgccagccccaagggtgtcttctacaacaagttcttgttccctcataattcttctgacaaattcttcttttgatccagactttcctagccatcatttcattccagaagtggcatgtgtgtgcaaacactcatgcttgagggcgggacaagcaaagggataagaggggaaatgggaactcgaaatctgctcaaatgtggtaaagaaatatatccagaaagtactgcctactcaccaaaatactatttgctttttatattctttcctgagtagaatttcctgttcaaacttgaaaatgaaaattcctccacttcaaaatgaacaggcaagaaatgctgtaggctgggtttcccggggaggggggactgacagccatctgccctgagactgactgtcaaatctgaactctgtgtacttgttagtgttgtttatgggaggggtgagggaagggaggaagcaacagggacctgctaaccctatgaattctccctcatacccttaaaaagtcgggtgcttggccgggtgcagtggctcacgcctgtaattccaacacttgggaggccagggcggttggatcacaaggtcaggagttcaagaccagcctggccaagatggtgaaaccccgtctctactaaaaatacaaaaattagccaggcgtactggcaggcgccggtaatcccagctactcgggaggctgaggcagagaattgcttgaacccaggaagtgaaggttgcaatgagccgagatcatgccactgcactccaacctgtgcaacagagcgagactccgtctcaaaaaaaaaaaaaaaaaaaaaaaaaaaaaaaaaaagtcgggggcttgccaagctcgctttttggggcaatgggagggaaattttaagagctgatttctgtgatctttatcagacctcttcttctgtcctgcccacaggtcagtgatgggaatgatagtattgcattaaaagagaagtgattccccagatgtggacatctcagtgcctgggaggcagacgtctttagagtgcttggtgttcctccccatatctaacttacctgttcttaggacatattcccttgagtgtcttttattatttcgttgattgattaagggttacaaatttgttacaaaagcagcagaaattttgaaagataaaacaggtagaaactgttatttaattggaggcacaaaagccagttccagcttgagcattaactggctgtgtggcttgggcagctcccctgcacttttgggaccatggtttcttcagctctaaagtgaaagctgagagttcctctgaatgctaaaatcttgcttctctgtgattattgttttttaaatgccgccgtcatttcaaaacacatacatggggcagccctcctcagctgcctgtcctgttctcttccctccttccctttgtgccatcagcgtctcccctggatttatcgtgctgtactccttggacacccttgaaagtggagagagaataattctcattccctttccccaaactctgtcctgaagcaccactccccacctccctaccatgcctgcccctccaccccccacattttccctctgatgagatttcctctctgagggaatattttggtcctgttctctgttcccaaacaaattccccaggtcctttaaatctggtttcaatcaacataatcacagtctcttcgatgctatcaactctgccttgatttggttgtgtgattcatgctgtgtcctccacctcctcaggctgttttatatatacacacttaagtgctcatatatatgtgtatatattacacaggttgtatgtatatgatgtattgaaagagagagatgttttccaccgtgcctgtaattactttttatcttcctccaaatcagtatcttaatgcatatcacctaaactggattcattttgagaacactagggccttttttttacttttcaagaacagctatctaattctgggccaaaaactagttatcaaatgagggcaggtaatggagttgtatccagcgagggggcatttgcttctccatatgatacactcctcaccagtaccaaggcgttttctcttcagtcttcatgcctatgctgttacgagtcctttctcctatttgaaagaaaagatatgaggcagcccagggaaagctctgatggaggctataaagacaatatggatgtaaactaaaaaatggtagcttagagcttaatggtagcctctcaggacactcaccacacctgaattctaccagcctgacgccaatgctgctccgcttatgctgggatgtagtgacacaggacactctgctgggggatagggatgatctccccccaccaagtgggtcatcaacactcatcactcagaggggaggtgggataccaccttgaacagagaaagcggctgggcatggtggctcacacctgtagtcccagcaccttgggagcccgaggcaggtggatcgctttagcccaggagtaagagaccagcctgggcaacatggcaaaaccccatcttcattaaaaatagaaacattagcctggcttggggttgcacacctatagtcccagctactggggaggctgaggtgggaggatcgcttgagcctagggggtcgaggctgcagtgagccatgattgtgccattgaactcctgcctaggagacagagtgagatcctgtctcaaaaaaaaaaagaggaagaagttgctgaatccgtcttataaatctgtaacagaaaattatggcaagttgtggcttttaattgccagagctgggcacttaagagagaaaagggtttttgtgaattccaaaaatgtaattgtattcattgaacactgaagtcaggagaagtcagaccataatgacatgggagccattttcgcaaccagcagactagaaggggagggtttggaagggtggcggcagagcttagacacctgctgcgaagggagagaagtggggacagaaagatggcctgtgtagagtcccatgagaaagacagaactgcactggcaggcatctttaggggcccaggtcacaatcatggggccggtggacagtctccagggcactgtgattgtcacagtgcacagcctaatggggaaaattgcacagcttcacttaaatataggtgacatatggacgtaagaattcatgattaatctagaactaaccctgaccagcaaggccgaatgaagaaaaaatgtagaaacactgaccaaaccttcctcaaaggtcacagatcttagggaatgtgtctctctttcacatttcaaaataacaacaatttttgaaatatgtattttttaacatttaattgttttatttggggataattttagactcatggcatccactgtttttttagttacccacatatttgattcagtaagattccctgtattgatacaaaaaaagaagagggaccctgtttccctttgacactgttactttttcctgagctcattgtttgtttgtattttgttttgttttggtttggtttttgagatgtagtcttgctctgtcacccaggctagagtgcaatggcgcgatctcagctcactgcaagctccgcctcccgggttcactccattctcctacctcagcctcctgagtagctgggactacaggtgcccgccaccatgcctggctaattttttgtatttttagtagagatggggattcacggtgttagccatgatggtcttgatctcctgacctcgtgatccacccgcctcggcctcccaaagtgctgggattacaggcgtgagccactgcgctcggcctcctgagctcattttaagagagacttctggcctagaggtttgaatgagaagaagttatacagctgggattcttccctttctctgatatgaggacaggagttctctctcatctccgccaagagcaggaagctggagtaactgccacaagctccaggagggagtgtctagaacatccacgttttgcagcaggaaaacaccccctcacgctgaagtttgattcctgaatcctgtgtcgcagtctaaatgctgaggcagaaggggacatccgtgttcctggggcattccacttgcagtcctggctgtaacccgagtgagccatccgtgtagttcctgttgctaagtctcccctgccacctcttcttcccatggctgcagggcagggggccatgccctcctcttcatttcctgtccctgggtgagcgtgccccctgccttctcccagatctctgctgtggcagcttcacgtgggattcagcactgtgtctccttcccctctgctcggcctgcccatacctgtccagcagagctgtaagaccagaagacagagcattccccttatctatgaagtcaaatgcatgtgtggaacatgccacccagcctgcagtctctctactataaaatactgctcataagacaaatgtgtggcccagatgatttctgataaagtctattattttgaaatacatatgtatgtctctcagccactgatacacgcagaagctgcacatgttgtcaacacctgctttgagctcctttccttcccacccttccttttggcaatgcaagtttccattcattttctgcattactggtctcctctcttctcccctactactagatcttacaataaacatttgaaatagtttatttgtccacagtgtgatttctgttgagaaacatgggctcaccgacttttgggtctcttctaacactagaaattcctctggttttttagactatttcaagggctattaatgtggaacagacggcctttagaaacagcaatccacagggggcccggagacctggattcatatttctcctagcgtcaactagtgggtgaccttagaaatgtcattttccttgtcgggctttagttcccttatctgtcacacagaagcactgtgtgagtttgggaaaccaatactatgttgaaatgtacaaaataatcttaaagcacagatattctgttccctccaagaatacatcaaacaaaggaactgacattgcaagaagattttgaggagatggctggatgcactggagcagggattgctgagggaagccaggccctcacctggagcgtctcaggagaggcagcttcggtgctggctgtttattgcaggcatctctttctgtgtctgtgcgtttaggggctcttctttggagataagaaaagggttctggatggagggcagtgaagaacagtgagaacttaacatgaggatgtttgtatagaggggaagacttctggacagtggcttgactttgctcactgggcatttccttctggatctctgtagaagtcagggacagatctcctcgtgcatatctgtctcccagagacagatctcttcctagcagaaagtagaaagtgggcttcaggcatcctggaagttttctttcttggtgggtgataaaagggcttgcagagagaggagaatcaaatctcccacatgtgcatcatgcctgcgagtctcatgcagagatgtcttatgttcaacatagaaagcaagcctggcagccccaagaccttcctctgcacaccgtccatttttacttggtttcattttgataactgtgcggtctgaggtcctggccaagaaagcatcacctggcaagaagtgtatttggccaatggtaaggttaccatctctgtgtaattaggctccgtaaagctttgtttttaaatttattaatgggaatgatttgacattcctacacactgacattaccctcatggaatggataagaatctcaaggcttgttgggtgaaagaagggcagtgtttggtgtgacgggaagggaaagtataagcaggcagctcgtgcgcatgagcatttgggaaacagaacagaaatcatagaatggcaggcttaattctagctctgtcacctactggctgtttgtcattagaaaaattatttacccttcgtgagattcagtttccttacatttaaaataaagaaaatattcgtcctcatattgaaatgaattgggctatcatgatcaactttaaaatacaacgaacagtataaatgtcaggaattatatgacattcgggacctccactgccaccctcactttctccctccagtggtcacttactctctgtccctctttctgggtcagagcttctgttactccagcctgggcctgccttaagtggggacatgtgctgatccctcacaatgccgggtgacaaggagggttttcaaggctggcttgactgccactgctggtctctcttctcatttgcaactgtcttctccccgctgggctcagtgttcctgggagggtgatgctgagggagaaagctgtggcagagggacgtggcagggtcagagaccactgattcgcaggagctggcctcagagctagcctttttgcattgatctagggaaccagtgatcatagatatctatgttgacgcctgtgtcaatttatccctagagccattattcagtgaatttcctaaggggaaaacaattctccagcattatttttctttgggccaggagagcactttctctgagttttactggcaagctagatatattcttgaaaggctccagcagcagagttcccgtcttgtttagttcaaaaacagctcctggcccgtctctaaatggtcttgctaaaaacatctcctcccacccatagacctgaacttaagcctcagactgctatcctctctttctgccactgtgagagacctatgcctcttttctcattggcttttgcctgcccagccctcctcagatccttgtacatccctaggaagtacattctttccactccacacacataattgtgcaacttgtgctaggaccgcatgaggcactggagctgcagatagcaaggaaatgtgggccctgccctcaggaacttgaaatccggtagttacctagagctacactgagttccctgacgtggtaggaagccctcccagagccttgtccgtgcttagacgttgccttcacagaggtggctaaggggcattttgtccctgccctagtttttacaagtcccctggatgttaactcctacttgcttttatttgcaggttctccagtcttatgcattctctcttattcctaaaaatttccaatccagtgctgatagtatgttagagctgtagggccaggaaaccctgctgggggaatcatcgtctagtaggtggagtgtgagagagaggagactcaggccagaggggcttctgagttctgggcaagtcccttaccatcctagtgcagctatccttctccatgtcctactgagctgccttccttcttgcttctcattcccaaagagaggcaaccatgccattctgggcagtgggcaagggctgctggaattgagatttttatttttctctttggcatctgaatccttcctttgcagttgctgacatgcagttttgtgtgagatcacccatgtcatccatcatcttcaggacacccagaaactcctcctacctctctcagcctcacatgcgcatcttcagtccccttctgattcaccctagttggtctattgctcttggctctgaataaatacctttaaagggtacaggtatccatatggaaggccttcagagaagagagagcatggaatttattttccaaagtgggacactcgagagtgaaagggtgagctgacaataatgatggcaggacaaaagcatatttcaggcttcttaagagcttcatccctttgatccagtgactttatttctaggaatcttttatggagtacctaccatgagccaggcaccattgcaggtgctaaggatatcaaaacacatcaaaagagagcatacagttaagtggagcagacaggcaagaaaaaggatggttgtaaaagaatgcggtaagtgctgagaagtctttctcagagacgtgatgtatgagcaggctcagacagtcaaatagtagttagccagggaaggaaagggagaaattgccttcctggcacagggagttgtcaggggagccctggcagaggtgagagtatacatggtgtgtttggaaaacccaggtccctcgctgaggctgctgtgcacagggagaggagggctggcaagagatgaggctggcaagtgaggcacccaggagccagacgatgaagggcagacaatgctgaggaattttagcttgatcttggaggttatagagaagaacagaaatttctccagctgaggaatgacccaattccattccagtgcggggaagaaatgatagggaaggctgggagagggcaaaatagggtctcggaaaccatttaagagtctattgaagtaatccaggcgaaagaggtagcatggactgtagagaaaaggagggtggattttgagaaataggaggaggcagagtcaactggaattattaaagatcagttcaatgtgggggcagggaagaaaggaagaaagaggactcaaacatgatttctggtgctgccttttcccaagagagaaaatccgagaggctggaggaggagcagggtttgggggaggatggtgacttcagctttggatatagcacccttgagattcctctgcagttcaggtggagatgtctagtaggccatggatgtcccatggatgtctatgggtttggagtataggacggaggtctgtgcctggagatgtgagcatagacgtatctacacatcagcagggttgatgagattgcacagtcatatcctcagatgagaagggaaagcagaatgttggagaagaatatggaaagaatgcaagggaagtgctggtggtggtaggaggaagaccaagagaggtgccgtctggaggagggatcggagtgtccagtgattcagagagcatgagggaggaggggctgtggcacacctgcctgactttgaaatgaagaatggtattctaggtggggctgtttttttagggacctggtgcaggtggggatgatggacatagggaattctactctctgggagacagcatgtggctgggatcagatagttacaaagttatatgacaactattttatttcatttctctaatactggcaacatctgaacattatctacagaggaaggaaaacctttatggaggggtaggttgaaaatatgtctgggccaggcatggtggctcacacctgtaatcccagcactttgggaggctatggtgggaggattgcttgagcccaggagtttgagaccagcctgtgcaacatggcaaaaccccatctctacaaaaaatacaaaaaaatagctgggcttgtggtgcattcctgtagtcctagctacttggaaggctgaggtgggaggcatcacctgagcccaagaggtcggggctgcagtgagctgtgattatgcccctgcactctagactgagtgacagaatgagactctgcctcaaaaaagaaaaaagaagaaagagagagagagagagagagagaaggaaagaaagaaagaaaaagagaaagaaagaaagaaagagagaaagagagaaaaagaaagagaaaagagaagaaaagacaagacaagaaaagaaaagagaaaatacacctgggatggaggccctgatggaagaaggtttctgaggaaatgggtgtgggtcccagagtgtcagtatagggcctgttggagagcgagtatgataaggtcagccctgccactcagaagaaattctggttatactcacagtaatcacacttcctggttgacccagggcagtcctaccgtgcaaccattaccccaacaaaattattgcttacaccccttttcacttttgaaagtttaggtgataaagtatctggtctcctcagagtatacatctaaggagattcgtaggtggagttagacagctgagggagctcctacctgaaggactctgtgcagcaggaggcaggattctctgtatgatgttccaagaggcttgaggagataggagcagctgtgaggggagggaagacctgaaatgagaaaaagagcaaattgttgatctacagtaagggctgagcagagcagatccttgagaacatcaatttgctgggcaccaagtagttcataggccgcgtttccctgtctttagcagcctgcgtgtctgctgggagaatagatgtataaactgatctgaggttggagctgcacagggcagatgtggccagagggtaaggaagtggctggagtggtggatcatgagaatagcacacccgtagtaagctctgcacatggagatacttattgcagcactgtttatgggagcagaggattcaaaatagtaaatgtccaacaagggggtgtcatccggtaaattatggcaaattaacgtgatagaatattatgtggccatcaagattttgtttaggtagaattgtaatataaggagagaaagcctagattgtaatagtaagtgaaataagaaagttccagaatgatgtatattaaaccatcccgcctataatgcatagagatttttttatttatttttaaaaggttgggcacaaatattccataataatacctgtgggagctgatagatgatatatttttgtatttttaaatttttcttcaataagttcattatattacttttataataaggaaaaaacatctctctaggaaaaattatttaaggaaaaaataaacatgaaaaagggtgtctgtaatcacagtttaatttggccttctcagaaaaccattgtagggagtttttattctctagtttccccagggtggggaagatgagcagcatggccctagtgtttgagaacgtgggttttgatatcagacatgcctgggtttgaatcccagctccgctaagctgagctatagtattgccatggtgtgatctcaagcaggctatccttatttatgaagtggaataatacacatccccagtctcttctttataattccgaaacccaaaaagccctgaaaacccagagtcgtttcttaaagtgacagcaaattcatttggctataaaacctaacctgaattgagctagtctttatttcacttcagtgaatataattttgcagtggaaatattaacatgtttaatcattggatgttcgcccagatctcacggagggtatgagataatacgcagggttcaggtaagttgtgaactacaggatctgcgtcatagggttattgtagaatgaagtcaggttgtgattgcagggttcttagcacagttcttgccagagagtaagtactgacaaagtgagttatcatcactattgatgctataattattcgtgagccttcactaagtatggagtgcatgatttctgcttgcccctcttccctccatttccttctttattgggatgtttgagaagattaatgtatcacatataatgagaatttaggatggcattgtttaggacacaggactgcaaaaaagggaagttccagcacagatattttcctgcctcttttcttattccagatttctcactttctggggaattagctgtaggatataatgcacattaacaggacacccaaatacttgaagagctaatggagaagtaacccttactcccttggtgactgctttcgtctcaaagcacatgtgttcattataaaatgttaatgtatttacaccatagttgctgtacatttaaaggtttactgtgctttaagctaaaactagctggatatcaaatgtgcttttaattgaaaagtggttatttactgctttccataggaatccacaataagattttttcattgcaaaccctcctagtatctttaaaatgcaattcagttcacaaacattgatttgcattcaacgtttttcagaagcctaaatagagtgcaaaatgaggtccacctgcaagactacagttattacttcctcctttttcttggaagcatccatgcattgtaaattctgtttgtgtggcatcagccaactacattattaacatcaccaggaggaattaaaatgtatcatgttataggatcaaaagtttcacattctgaatcaatgccagtataaaaagaatgtccagacccttccgtctgactacagtcggcagggatccccgccccagcagccatgtgactcacttcgcattgtggtgagggtcactcatggctcatacgggcctgcggcccgataggcctccccatggggcagcatttagccttttcaaaatcagcttaggatcacagaccctcaggtcttgaaggaactttttggagtttcctctattaaacccagttttaatctggtcatttagactgcatgtctagaaacactacagcatttttagtagtaaactgaaataaatcttcaaataaacgactttaacattttgcacattggtccaggggcagaagagctcgtctgttgccttttaggagggctctaatctttttctgtttcagctcatcgggtcctcattgtcccctactgtatgtgcccagcacaatgtcagggcacatttctacacaatgttggattccagctgatcctccgtgttaatccattcgttagtgccaaattgcagggttccttgccaagcccgtcagcacaatcagagcttctgaagtcaggtacctcaattacattagttcagttgtctcattagcccccatgcatcatccaaactcatcatcaaacgtgttttccttcattattgttgtcattttcttaataccagtcttgttgaaaaaggattgttttagatacaattttgcctaacttgtttcatctccagaatacaatcctaaatagagccaagatttgccggagagaggagatagcggttgaggctggtgaagcttccctccggttagaattagagagaagtggatgcagaacttgggccagtaatggacccatccatctccctagtcaagaggacattcttgcagccagaggtggttccgctttggaaatgatctactttgtgtaaaccggtgcatcacagatactgttagagtatctcacagatactgatacagcatggtctgcattttgtagatatgagggctctcccttaggtttacagccggataaaggagctccacttacctggtgatcacaggcatgtggtccaccctgctgggctctaggactttgaacatagagaaggctatcttttaggaagactgcaggatcaggagtcgggaagcagggattctgcttgtagttttacatctagcagtaacaacttttagcccatccctcacctactctgtgccctggatttcttggctttaacatagcaaaagcctctctttatagttttcctaactccatctctccccaaaaagctggagatgtaagttttaaattccagtccttggcacatagtaggtgctcaatctctcatccttctgtccctcaagatagccgatggctcagccatatatgttccagacaggtctctctgtgtcttttgggaaagccttgttgctctcagactggcctctaggcctcatgttttcccacttgctcttgccttcagtgttaggtcatgggcttgcctcattacctgtttcaaggaggcctctatttgatccctggagcatccctgggagtctgaggcctttaaggactcctgtggtctcaaggaaaaagaactataagtagttctcaggctcccttgatcaattcaaagtcatcttcagctcttccagtgcagcccctccagagctgttgaacgccacctttttcctctttcgggaaacccacaaaaccttgcatggggttgtgctctgtatggttttccagcatcaaattcactcatcaaaagatgcatcaggagggtggagggggtggcgcctggggtgagggtcaaacaaggaaggccagaatgcctgtttgcattcgcaacgggaacattggaagttcgggtggaaaaacaatcccaccggcctttatttaccacagtgggtagcctcgggaggagggggagctgggtgggaaaggaagacaatagaatgctgtgttgccttgctgtaaaagcttgctctaagcaaataaagtggcaagctcagtcagagccctgctcaattagccccagtgcttaaaggagggtctccctgcagctgttggcggcgggcgggctggagcaaaggcaggcgcactctggggcactcgggaggcgaaccggcaggaatcttgcatgggagctgacccgggagggagaccaaaggaccctccaacctgatcccagtccctgcttcttgaacagagggctacagaaggggttggtggggccactctggggagaggcagtgtggggagaccacggaggaggtgaccagaaaagtgagtgcaaacgtttcatgccgagagtgaccgacatatggaacgtgttatccggaagggttacaggctggaggagctcctagagtttttcagggggtggggtgggggagggggaagccttcagaaactcaaggaggtttctaaacaaaaggaatttgagaagggttggagaaataatgagaaatgcaaacttgacccagagtttctccttccatctcacggcttctcccctgcctgtcctcacatgtttccagttcatggggacccaggaaggccactggagccctgtgcctgactccacgtgcacctcactgggggtgtgggtggcggggtagggaggacccgcagagctggctcgctgctctgtgctgaaagggacccagagagcgagagccctgcctggctttagacccctgtggactagcaggctgctagcgccgggatggtctctggatgatttactccggttcctgcccttgctggaggagcaatttgatgccggactgggagtgaaaaacagacttgcccagggactcacagtggccaaaggggaggctgggagtagacgcaggctcttgatcccttctgctttttggcatctccccttctcagcatcccttgcccagcacaccacgcacacatgtacatacacacgcagacacacacaccaaacagatgcacacagaataacaacaccacacctacatgcacacatacacagacatacatgcagcacagacacacacagaataacaccacacatacatgcacaccacagatacacagaataccacacacacatgcacacacacagacacattcacagaatacatatatgcacacacacacatacatacatgcaccacacagaataacaccacacacacatacagacacacagacatacacatacatgcacacatacagatatactcacagaatacacacatgcacacacatgtatagacatacaccacacaagcagaataacaccacacgcacacaccacacacacacacagaataacaccacacacatatgcacaccatacagagacacactcacacctagacatatacaccacactcatacagagacacatgcacacacatgcatactacacacatgcacatgcacacacaaaaacatacacagacatcacacatgcatacatatacacaacacacagacacacccacgggcttacacagacaccacacacacgtagatatgcacacagcacacacacacacagagaaacagacacactcgcaggcatacatgcatgcatacacacactacacacagacacactcgcaggcatacatgcatgcatacacacactacacacagacacatctgcagtcatacacaggcactacatacatagagacatacaatgcacactcacacacagacacacatagacacatgttgtgtgctcatgcgtacacgagcgcgcacacacacacactgcctgacttgtttcccacaagacgggtactggcctgtcgcttgtagccctcctgtcccagcctgtgttggccagggtgccaggcactgccacccctcttgggacaaggtacaggtggccagtgtgatcacggcctgttctgagagcctcttcctgagccaggaagcgctgtgtgatactgagtgcccgtgccttcgtctttcccatggtgctgggtcttggccacctgctgcattgatagcacccgcatgttcacttccctggcagtagaaagaaatgtaggttagtgcagggaggtcactggctttggagatggtggcagggtggagcagtctctaatgtgaatggaagtgcacatgccctctggacctgcagcaatgctggcttcagaggggccttctctggtacctttccaattttccccaaccaggtagaagagccactgcccagtgtcttgggctcaactgaaaccccctgtacaagaaagagacccccctttccactgtgtctctctcctcctccccactcactgtctctctgtctccctcactccgtgtctctctcctctcttctgtgtctctctgcctctccctctctctgtttctctctgtatcgctcttttttttcaatctctgtctctatctctcctcctttctctttatctctctgtctctccctctgtctttctctctgtgtgtgtttttttttctgtctttctgcatctctgtttctgtctccttctctcggttctgtatctttgtccccctctctccctatctctgtttctctgtctcagtccctttctgtctttatgtctctgtttatctctctcagtctctgtatctctgtctctttctctttttatcctttctctgtctctttgttctctatccctccatctctctctccctctccctcagtctctctctgtctcttcctttctctgtctcagcctctctctgtctctgtatctctatctctttctctctctcccagtctctctctttctatctctctctctctctctctctctggcactcactcacccacttacttgaagtctccatgagcagtgggtggcttcacctttctgtttcgccactttgcagtccgacccgtggggcttgcagaccctcttctggcgcacaccttcaggagaccaacggtgccagggcactcccgtgttcttcagggttccagccccgagtagttggtaaacatcagtaatcgtcctagagatccactgtagattcctcatccaggtactgaatgaggcccttctgagcaaatttaatggaatgaccttggtgacattacaagatgacggctcatctcctgtagtctattattgttgggcatttaggttgatactatgtcttcactattgtgagtagtgctgcagtgaacatatatgtgcatatgtgtctttatgaaagaatgatttatagtcctttgggtatatacccagtaatgggattgctgggttgagtggtatttctatttttaggtctttgaggaattgcttaggtctttgaggaatcgcatttgcgttttcaaacatcatggagaacacaggtcttgaggatgtgcaggaacatggagaccaaggaatgaaaaagccatcaggttggaagtgaagtcacccagagtgattgcaggtttatggacagaaaggaaaatgctctgattcctggtgtccatgaggaaggtggatgccaatagatggtgctacacagacacttgtgaaaggaagaagggaaagagtctgcctccatgggctgagtagggctgctggggcctcaggcttcacacatagtgtcagacatgctgtgttggtcaggttcatctgggacccctgtgcctcccccaggaaaccctattggtaggtgtgggcaggcttccctccatgtgtccttaaatacactgactgctctgtgtgtgactgtggatgagcagcgtagggctggtcatctggagggctgggcttggttccagctcttgtactgatggattgattggttttgggcaagtcacttccccccataacctttccattgtaccacaatcctaatagagttggatgccagtttctggcaccctgggcttcacagggacacagagaaacagagaggaccagaaaattaggctgataataatcatttcttctctatttggtctggagaagaaatgacttagggttggcacaggttaatatgtcaactagaaagaacctttgaaaatctttagttcaagaattctaaacctaaaatctgtgggacactaggatgatttttatggactctttgaatcaccctgaaattttttaaaatattttttctttatgggcacatgtgtggttttttagcagaaggattccttagcattgattacattgtaaaagggccaacaatcataaaacaattaattccccagcatcatgttatgtgattcataactgaggggtctccgcagatggcatttggaaacgtgcgggtcctttttttcagttgtcagcatgactggggtcacgatggatatttagtaggtgggggcctgcgttgcatgcgtgggggattaaacttaacaataaaaaactgtcctgtttgaaatcccagtagcacccctctggagaaacactgctcaggaactgagcccccaagatgcacagtgattctcccgtggccacaaagctcattagtggcagagttggtttttattaacagatcaaaacaggggatgtgccaagaacctacattattttgtttctcatcatcagctgcaaatgtgctgcaatctgtgaaaacaaaagaatcagaaatctgtcccaccttcaacgctccagccatttttaaaaatgagtctttgggttcttggttgttttttaccatcaaatgagaaatgaggaaaggaatattttacatttggagaaactaaaccataaacaattgatcccactagccccatatcacctagatgtgttcttcagctactgtgaattggtgacgcaagccttagactggaaatttcccctttatgtttcagaggatctgtcttgaatgtctcttactctacaaagaaagaaacattaatataccagcatgctgcttgctacctagtttactgcaatgaagtggcaggtgccttagactttggagtgaaattgagagatattccgcagtattagctaagagttaggcctgtgggatcacagagacaggggtttgttccctggctctgtctctcaattgatgtgtcttcttaagaaaaagtacttaatccttctgagcctcagtttccttggctgaaaagtggggataataatcgtatccacaaagattaattgagatcatccatgtgaagtgttccgcacagtctagcatatggggaggctcaataaatgtgagctgttattacaagcgattattatgacttgtgtctgtgattaaagacagcctgaggttcagagtgtttgtgccaaaattgctttcagaggacaagctctgggttggtttttcagtcttgcccagctgcccagagtcactagagtgtttggggctggagtcacagtgtttattaagtgcctaccacacactccagttttgatggaagattggttttcttcctgtgtgcacatccccgcatcactacatgagtgggtgagaagagactcagaaaagcaccagacacatgtttcttctgcctcagttccctagtctgtaaaagtactcaagagcatgatggcggccacagggaacagaggggagagacacctggaggagcaaaagacagtcccagctgtcagtcttcagacaccatggttttctggagaagggatccagaccagaccgccaatcaatatagccgcagaccgccagtcaatatacctcatccttgtgaaaggcggttgtctgtgtggcagcagggagacaggaggggccatatttgacacaagcctgctggccaagtctaaaggagtcagcctgccatctgaccacactttctgcagccaagtcctctgggggccaaatcagtatggtttgagtttatccccgacttgctgctatggttgatgcacacaaaaaaggtttggccattgccaagccagctgtggtcttggtttggaagaggcaaccaaagtaagaattgaagggaaggcatgctttgggatttcccttagccttcaaccctctagaggaagccaacttctttattctgccattttgagactcatgcttgtctgggtggataagataaatactttcatcattatcatcattattattaattataattattgaaaatcaattactcagcagcccctaccttgtaatggtatcacttacagttgtatagcattttgcagacaacgtatacactagaccataaactcagctcgaacataagcataaatttaaaacaaaaacattgacttgggcagctattatctgaggtcaaagttattctttaattccagctgtaccttcagctgcctatgtcgctgaagcaacttccccttgtgtgttttcacacttagagattggagtaatccagacacagaaaatgataccaaaattgaaatgtttctgaacgttaaatgattcaataatttgaaaatagtttcaaatttttcaaaattcaaaaatttgaaaatagttcgactagagcccatcctcacctcaggtagttacgtggtgtgtgtgtgtgtgtgtgtgtgtgtgtgtgtgtgtgtgtaggcacacaaacccatgcatgcacacatgtatgcacagtggtggatgagtgtgagttaccaaaacaaataccactaaatgcaggataacaccatgatggctagtagctggattgactcagattttctctgcagatccttcctagtccaccctccttccatgacatgggagtttgtgatatgcaaaggataaagtaaacctgagtttcctggggcttgtgtcggcataccaagctcctttaagatctctctttgccaagatggggctaagccagaggcttccttggcctggggaataactgtcctaccttcctccctggagcggctggcgcacactgttttgacgtgtgccatgccttccatcttttacggcctcggggccagaggagggtatgctttgaacaatgtgaaattcctctcctaacagctgtgcaaaggaaactcacagctttctatctccatctcggtccacttagctttcttttggggtataggtttcttgtctgttcaggggtccctgttcctcactttctggccttcagaaggaccagtttcagtacttcctttcttagggaggcaagtcagtcttctgaggttctctgttttattttattttatcctagagtatgccttcactgttgaccgtgtcttgcctcatttctgctaagaagccagcatcttctgaaaattgagtgtcttgtcctgtttcagatcttgggccgaggattgaccatgtatgttagtcagtttcagagccctgagttttaagtgctaagttttaaggagaggaacaacagtagaattagatatcttaaagaacaggataggaatccacttccctgccccttctctcacctggtttgacactacatagatacagacctgtcctgagttcagggattgtctaatgaggcctcaccaaataccaacagagagactagctgtttctcctctagctcactgactgcttctagttttccgtgactttagagcatgtgcgtcagcaggttttggggaccatctctggcctgctttctgatcttggctctgtccctcaatttatgtcttttttgtgctccataagacagggagtttcatggttgccactacccgagaggtgtgctaaagtgaatgaggtggaggacacagagctagcagggaagaaggtgccgtggaaacccacacagctttattcatgtgagctcatttctcatttactccttgtagcaatgccaagtcaccccctcccttcatccctttccaagcatttccctcccttgttggttttggatccattgtaaccccagtgagttaacctacatgttttagtttgaatctaatcatgctatttccaggttgccaacccccacgggtgcttcagcctaattggtctgtcctcactggtgtctgcagcaccttccctttgagcgtcatctgtgcattttaattaatctgccactttttcctccctcctgcttccggatcattaataaagagattaaccaaaaccagaccaatccccagcggaggctccaccaggatctctctctcccagctctcagctttgtcatgggtcagaacatcatcatgtggccccattgactaattctgaggcctcaagacctatgttcagagcaaagccagtgtgaattaatttttcaattaagatttggggaacaagcatagccagtcttttatatatggccttagtttaatatttccaccacattcctttcccttttgtaattctactttaaatctatcactttcccacctctctccctttccagtccctgaacaagacattagggttatctggcaggatgtctcctgagcctgtagcattagtcagagatcatgtcatagccgaagaaattctccaaagaatcaggcccttctggacacagctggccagcgtcctctttgaccccagccagagaatgcatttgcctccagagaatatggctacaccagaaataatgaaatctcttgaatttgcatattaaaaatttggcaaattaaaatttgctttcacctctgctctcatgactcctctctgaggaaagctaaaacagagcctttctgctttctttgtaagtcacccagatttccagcgctggtctcaaacccaggatgtgagatggtgcactccgtgttctgtccactacaacacagggcctctgcaggcacaggtgacctgcagatgggctgcactggagagcatcaggcccaggagggactagggtgagggaattggattgtgtttacttttgtgggggatgctttcatagggaatacagggaggaggacacaggattgatggcctcaaatctctgcaaactctgcttagagctgaggcttcttggggaaggacacagcctgctgacagcagccgtcctggctccaggcttggagcttgggcttcccctggaagtaaactctctagaatgtttgagagcaaggacagacggagaggcagccgagtgtcatcattaataacatgagctctagagccagaaggtgcaaatcctgactctgttgcttgttagctggttgtggaacccctctttgccttggtttccccattcaaaatgggaaatataatagtacgtacttcaggatggttgttactaggatttaagatttatgtaagccagtacctggcactttgcatttttattcttggtgatctcacccctaagcagtctaaaaatttacttcacacatgtgcagcaagaggcgtctttaggtacacggtcaggaggtgctcctgtgtagggaagctggtcctggagaggtgaattggaacctgaaggctgcagcccagtctctgcacgtgacagggcagacgcaggttgctgggggctcagattctgtgccactgtctacctcagcttccttttccatgtcagctgcttcttgaatacccccaaaccctctgtggatgctgtaaactgagccaaaaaggaggaatcagaaattgctctcttttgagtattttgagggatggtgaaaccttgtaggaatgttgctccagggactgagaaaacaccatatgtgggaaagcgtttctaagtgaggaaaatcgcacatgcacgtcggtcaggatcttggaaaactctgagcaggggaaatgggcactggggagagtgtagaaagggggttcactaaggtctttaacaggtctttttctaattatagccaagaagagcctggggaccatggccgacttcagagccagggcctgtattttctttgggaaaagaaggcagagttgattggcttccaaaaccaggcttggcaaaagcccatgcaggctctccagccagtaagcagtgcctggggtaggtctcgatcgtagcaggcgctcattcagtaaatagacgtcgaaagtccgcagcgtgtccagccctatgctgggagtcaaggatgtgtggatggaaaggacatggtccctgtcgtcaaagagaaggcacaccaacaataatagcacaatatgacaattgcttaaatgaagctctctgcagatgacagggacccctagagaaagagcgtagacattcccctaaatagcagaactcgctgctgtgccttgcctggatggagctggcactgccttcctgtttccattccccactccagggaactggcccactgggggactcccaccccggacatggagtgagaaatgaaggtattggtggccaaaaagtgaccagagatcagaatgcatctattcttgcccccagcaaattcagaaacaccacctctcccttgcccgtgtttgctttcgtcatttgtctgttctctgggcttcgagttcataatattcctatcttctcccacaaccagtgtaactggtctgagatccaagcagtcgggcaccatggcatctgggggaaagccttgtggggaccgtgttggtaaagattgctgtgagccagatgtagaggagggagctctccagactctgggtccctcgcccgtgtgcgtcaagggcaggtgtgcaccatctcccgtggccacaggccattcagcttcatgttctctaacatttctagtgtgctcactctgtacctgatgctatgctaggtgcttccatgtggatttcattgtttacccctcacgataactttcatggtgcacaagccatgtgatttttgttgcgcctacgaaccaaatgcccccgtcactctctgccattgtttagcagtctgaccttagacagctcacttcaccacaactgcaggcctccgttcccttatatgtataaatgaggaggttgtctagggtcctttccagctgcaaacctctgtgttttggggagttctgttagcaacattcttggacttgctctctacgagaaaagctagaagtcgattattaaaatggagtccacaggaagcctgcagggctttaagacagccttctaaagagtttagaaacactcaccagcctgcagatgacttactcccactacttattacaaagtatcatggcaagtaagaaagaaatggtcagccactgggagagcaggctgaggttgcaaggaagtggcaggtgctatcgttgggatcttgggggagcattgtagaaaggtcagctttggaaccaggcactgaaaaacgggtgaaatttcaacaggagaggcagtgcacatgggttgtgatttgagcagcagtgagtagtgaatggggttggagcaagaggcctgtgagcccagtcatcacatggaaaagggaggtgagggccagagtgcagagaacccctctcactttcctgtgggtctctcctcttctttttttttttttttttttttgaattggagtcttgctctgtcgcccaggctggagtgcagtggcgtgatgttggctcactgtaagctccgcctcccgggttcacaccattctcctgcctcagcctcccgagtagctgggactacaggctgccaccgtgccctgctaatttttgtatttttttttagacggggtttcaccttgttagccaggatggtctcgatctcctgacctcgtgatccacccacctcggcctcccaaagtgctgggattacaggcataagccaccgtacccggcctttctcctcttctttaaactgcatttaggttgtcctcatctataagatgaaggaataagattagatggcctctttatatggcttatctacttctaataaactttggttccatattccagccaccacccataaagactcttactttttcctcctcaatccatcagcatcagccagcattctccctctcagttcatcctggtcattacctcactaatctgtaccttgactcttattctacctgggacctcccctcactaaccatacttgatttatttccttaagagcggatatcctgtgtattcttagcttacagtggctgagcttttgggaggtttaacaaattgtttttcaatagactctcagtcctaaatgattttattgcagctgtattattctttttgaggggagtagagaatgtaatcctagttgtatgccatattttttgtattgttcaagttgcattttgttgggcctgtaatattgaagaaaatgtcacttgtatgcagaataggagggagattccttatgctgtagaggaaccattttcctaggatagtacaattccttagagtcatctctaagggtgagcagcaaagctagaatccctctcttggctttgaccttgaaggagtcagttttcccaaagactagttcccatggaaagaagatggtctccttatcacagcagcaagaggaggcagtatgagcagagtgcctcactgttgttgacctctagggacaagtgagccggcagtatttcagacaagctgggaaagaggctgtctgtgagtcctgggagcgagtgagcactggcaggctcagacataggtgctggttagcaggactgcttttctgtttcttgtgtcggctttgtttatttcctctctattttccccctggacttagtaaagtctttccgaaaataccaaaggtgaaccaggggaagagtttttattttccatgtttggacagaactttaaagaggaaatgatgtacccccctgggagccagtgaggtggcagcgatggtgattaaggagtgaatatctcaaggaggtggacgaattcggggatcactagctcagctgcccctctccacctggagcatctccttccagtgctaccctcagaacatctgggctttgctctagtgagggagagactagcaatgaaggtgtcttgagatcagcactgtaattccaccaggacgccaccggagtccggtgttaagcttctactatggcaacagaatgagagcgtggatgggttgaaatgccatttcaacaaggaaatagtagaattagaagaagcataagcactaaaaggaacattttgtagcagaaatgttaaaaatctaaaggaggcaagtgaatcaacaatgactcttctattctgggcaagtccagcccatttatgtaaggtggttattctgcatctctgtcttctgcaagtagtgctgtggcagagctgcgttttgtggagagcgtccccggggatggagcagatcagttggtgatgcgtatgtatcagaaagctcggcagagcaccctggaacgtaggccctctcgcggagtgggtagtggccctacatgttcatttccaagggcaggagaatagaccgttccagctgcggcctggccagggatgaccccacatctgacactgcaatatgggggcaactgaaccagtcctcagcctcagtgtgttccaggggctgcagctggggagcagtcgaactctttcttgagacaattacaaggccaccgctgctgctgctgaagggaagttactccatgtttacaattctcaggtttgaagttttcatgctttgccaaggtagagtgaaccatgcgtctttgcaggctcaagggatgtttaaagaagcggtaggacatcgtccacccacaagcagagaccgcaggataaagcagacatccaatgtaaatacaacccgtgcaaaaagcagagtcggcagacctggagtgcattcgcagtatctcccgggggtgggggaaagaaatcacctcttcagaatgtccagaggggagttgccttgcttacctggggggcggtaccctctctcgtgccctcacagggctactcagcctcaggtagctggtgccagaataacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatca
